United States Patent
Singh et al.

(10) Patent No.: US 10,669,593 B2
(45) Date of Patent: Jun. 2, 2020

(54) GENE CONTROLLING FRUIT COLOR PHENOTYPE IN PALM

(71) Applicant: Malaysian Palm Oil Board, Kajang (MY)

(72) Inventors: Rajinder Singh, Kuala Lumpur (MY); Leslie Ooi Cheng Li, Kuala Lumpur (MY); Leslie Low Eng Ti, Kuala Lumpur (MY); Rahimah Abdul Rahman, Selangor (MY); Meilina Ong Abdullah, Seremban (MY); Jayanthi Nagappan, Malacca (MY); Rozana Rosli, Kluang (MY); Mohd Amin Ab. Halim, Selangor (MY); Rajanaidu Nookiah, Kuala Lumpur (MY); Chan Kuang Lim, Seremban (MY); Norazah Azizi, Alor Setar (MY); Ravigadevi Sambanthamurthi, Selangor (MY); Rob Martienssen, Cold Spring Harbor, NY (US); Steven W. Smith, Fitchburg, WI (US); Nathan D. Lakey, Chesterfield, MO (US); Andrew Van Brunt, St. Louis, MO (US); Jared Ordway, St. Louis, MO (US); Michael Hogan, Ballwin, MO (US); Chunyan Wang, Ballwin, MO (US)

(73) Assignee: Malaysian Pal Oil Board, Selangor (MY)

( * ) Notice: Subject to any disclaimer, the term of this patent is extended or adjusted under 35 U.S.C. 154(b) by 786 days.

(21) Appl. No.: 14/226,508

(22) Filed: Mar. 26, 2014

(65) Prior Publication Data

US 2014/0302497 A1 Oct. 9, 2014

Related U.S. Application Data

(60) Provisional application No. 61/809,767, filed on Apr. 8, 2013.

(51) Int. Cl.
*C12Q 1/6827* (2018.01)
*C12Q 1/6895* (2018.01)

(52) U.S. Cl.
CPC ......... *C12Q 1/6895* (2013.01); *C12Q 1/6827* (2013.01); *C12Q 2600/156* (2013.01)

(58) Field of Classification Search
None
See application file for complete search history.

(56) References Cited

FOREIGN PATENT DOCUMENTS

| WO | WO 2001/48224 A1 | 7/2001 |
|---|---|---|
| WO | WO 2001/51627 A2 | 7/2001 |
| WO | 2009/061214 A1 | 5/2009 |

OTHER PUBLICATIONS

Baker et al. Systematic Biology 58.2 (2009): 240-256.*
Barcelos et al. Pesq. agropec. bras., Brasilia, v. 37, n. 8, p. 1105-1114, 2002.*
GenBank Accession No. GH159178.1, created Nov. 30, 2009.*
Billotte et al. Theor Appl Genet (2005) 110: 754-765.*
EMBL Accession No. AJ578630, created Jul. 31, 2004.*
Sambanthamurthi et al. Breeding Plantation Tree Crops: Tropical Species, Chapter 10, 377-421, 2009.*
GenBank Submission CF802307, Dec. 28, 2010. http://www.ncbi.nlm.nih.gov/nucest/cf802307.
Ooi et al., "A 1536-plex Oil Palm SNP Set for Genetic Mapping and identification of markers Associateed with Oil Palm Fruit Colour", Plant and Animal Genome XX, Poster Abstract (Jan. 14-18, 2012).
International Search Report and Written Opinion dated Sep. 10, 2014 for International Patent Application No. PCT/US14/31867, 13 pages.
Abdullah, M.Z. et al., "Color Vision System for Ripeness Inspection of Oil Palm Elaeis Guineensis," Journal of Food Processing Preservation, 26 (2002) pp. 213-235.
Singh, R. et al., "The Oil Palm VIRESCENS Gene Controls Fruit Colour and Encodes a R2R3-MYB," Nature Communications, 5:4106 (2014) pp. 1-8.

* cited by examiner

*Primary Examiner* — Charles Logsdon
(74) *Attorney, Agent, or Firm* — Kilpatrick Townsend & Stockton LLP

(57) ABSTRACT

Methods, compositions, and kits for predicting and controlling fruit color in palm.

14 Claims, 26 Drawing Sheets

Specification includes a Sequence Listing.

**a. Wild-type *VIR* cDNA sequence**

ATGGGTAATTTGCGTGCCGAAGTCCAACGTCCAGCTGGTGTTCGCAAAGGAGCATGGAGTGAAGAGGAGG
ACAGGCTTCTGAGAAAGTGCGTTGAGAAATATGGCGAAGGGAACTGGCGCCATGTTCCCCAAAGGGCAGG
CCTCAGAAGGTGCCGAAAGAGCTGCCGACTACGGTGGTTGAACTATCTCAGCCCTAGGATCAACAGGGAG
AAATTTTCGGAGGAAGAAACAGATCTTATCATCAGGCTTCATAAGCTCTTGGGCAACAG**GTGGTCATTAA
TTGCAGGTAGGCTTCCAGGCAGGACAGCAAATGACATCAAGAACTACTGGAACACTCACCTGGGCAAGAA
AGTAGAAGTTGAAAACAAGAAGGCGGAGCCCAGTGCTGATGCCAAAGTAATTAAGCCACGGCCATGGAAA
GTACCGTTGCAATGGTTATGGTCAGAAGATCAGCAATCATGTGGAAGCCAGCAGCCGCAAGAAAAGTTTG
GGATACCAGAACTACCGACAATCTCAGAGAACGATGAAGCGTGGCTGAATTGTATAATGAATGGAGATAG
AGAGAACAGTGCAGTGCCAGACGTTGGAAACGGGAGCACAATGAACCTGCAGAATGAATTTGGAATCGGA
GGCTTGGAGGAAAATAGAGATGGGGCAGTGTTTCTGGAAGGAGTTCTAGGATGGGATGACTTGCTTTGGG
CCACTATATAGTGCTCATATATGGTAGTGCAATAGTTGCCATTATAAGTTGTTTCGAACTTTAATGCTCC
TGAAATTCCCATGCAAGTATTTAGAGCTTCATATCCTACAAAAAGACAGGAAACGAGACCTTGAAAAAAG
ACTCAGTACCAGAAGGCATCCACTTATTGATTGCTTTTATACTTGCAACATGAAGGAAGCACGCTTTCTC
ACCAAAAAAAAAA** b. Event 1 Exon 3 sequence

GTGGTCATTAATTGCAGGTAGGCTTCCAGGCAGGACAGCAAATGACATCAAGAACTACTGGAACACTCACCTGGGCA
AGAAAGTAGAAGTTGAAAACAAGAAGGCGGAGCCCAGTGCTGATGCCAAAGTAATTAAGCCACGGCCATGGAAAGTA
CCGTTGCAATGGTTATGGTCAGAAGATCAGCAATCATGTGGAAGCCAGCAGCCGCAAGAAAAGTTTGGGATACCAGA
ACTACCGACAATCTCAGAGAACGATGAAGCGTGGCTGAATTGTATAATGAATGGAGATAGAGAGAACAGTGCAGTGC
CAGACGTTGGAAACGGGAGCACAATGAACCTGCAGAATGAATTTGGAATCGGAGGCTTGGAGGAAAAT`tGA`GATGGG
GCAGTGTTTCTGGAAGGAGTTCTAGGATGGGATGACTTGCTTTGGGCCACTATATAGTGCTCATATATGGTAGTGCA
ATAGTTGCCATTATAAGTTGTTTCGAACTTTAATGCTCCTGAAATTCCCATGCAAGTATTTAGAGCTTCATATCCTA
CAAAAAGACAGGAAACGAGACCTTGAAAAAAGACTCAGTACCAGAAGGCATCCACTTATTGATTGCTTTTATACTTG
CAACATGAAGGAAGCACGCTTTCTCACCAAAAAAAAAA c. Event 2 Exon 3 sequence

GTGGTCATTAATTGCAGGTAGGCTTCCAGGCAGGACAGCAAATGACATCAAGAACTACTGGAACACTCACCTGGGCA
AGAAAGTAGAAGTTGAAAACAAGAAGGCGGAGCCCAGTGCTGATGCCAAAGTAATTAAGCCACGGCCATGGAAAGTA
CCGTTGCAATGGTTATGGTCAGAAGATCAGCAATCATGTGGAAGCCAGCAGCCGCAAGAAAAGTTTGGGATACCAGA
ACTACCGACAATCTCAGAGAACGATGAAGCGTGGCTGAATTGTATAATGAATGGAGATAGAGAGAACAGTGCAGTGC
CAGACGTTGGAAACGGGAGCACAATGAACCTGCAGAAT`tAA`TTTGGAATCGGAGGCTTGGAGGAAAATAGAGATGGG
GCAGTGTTTCTGGAAGGAGTTCTAGGATGGGATGACTTGCTTTGGGCCACTATATAGTGCTCATATATGGTAGTGCA
ATAGTTGCCATTATAAGTTGTTTCGAACTTTAATGCTCCTGAAATTCCCATGCAAGTATTTAGAGCTTCATATCCTA
CAAAAAGACAGGAAACGAGACCTTGAAAAAAGACTCAGTACCAGAAGGCATCCACTTATTGATTGCTTTTATACTTG
CAACATGAAGGAAGCACGCTTTCTCACCAAAAAAAAAA d. Event 3 Exon 3 sequence

GTGGTCATTAATTGCAGGTAGGCTTCCAGGCAGGACAGCAAATGACATCAAGAACTACTGGAACACTCACCTGGGCA
AGAAAGTAGAAGTTGAAAACAAGAAGGCGGAGCCCAGTGCTGATGCCAAAGTAATTAAGCCACGGCCATGGAAAGTA
CCGTTGCAATGGTTATGGTCAGAAGATCAGCAATCATGTGGAAGCCAGCAGCCGCAAGAAAAGTTTGGGATACCAGA
ACTACCGACAATCTCAGAGAACGATGAAGCG`TaG`CTGAATTGTATAATGAATGGAGATAGAGAGAACAGTGCAGTGC
CAGACGTTGGAAACGGGAGCACAATGAACCTGCAGAATGAATTTGGAATCGGAGGCTTGGAGGAAAATAGAGATGGG
GCAGTGTTTCTGGAAGGAGTTCTAGGATGGGATGACTTGCTTTGGGCCACTATATAGTGCTCATATATGGTAGTGCA
ATAGTTGCCATTATAAGTTGTTTCGAACTTTAATGCTCCTGAAATTCCCATGCAAGTATTTAGAGCTTCATATCCTA
CAAAAAGACAGGAAACGAGACCTTGAAAAAAGACTCAGTACCAGAAGGCATCCACTTATTGATTGCTTTTATACTTG
CAACATGAAGGAAGCACGCTTTCTCACCAAAAAAAAAA

*FIG. 5* e. Event 4 Exon 3 sequence

GTGGTCATTAATTGCAGGTAGGCTTCCAGGCAGGACAGCAAATGACATCAAGAACTACTGGAACACTCACCTGGGCA
AGAAAGTAGAAGTTGAAAACAAGAAGGCGGAGCCCAGTGCTGATGCCAAAGTAATTAAGCCACGGCCATGGAAAGTA
CCGTTGCAATGGTTATGGTCAGAAGATCAGCAATCATGTGGAAGCCAGCAGCCGCAAGAAAAGTTTGGGATACCAGA
ACTACCGACAATCTCAGAGAACGATGAAGCGTGGCTGAATTGT‑‑
AATGAATGGAGATAGAGAGAACAGTGCAGTGCCAGACGTTGGAAACGGGAGCACAATGAACCTGCAGAATGAATTTG
GAATCGGAGGCTTGGAGGAAAATAGAGATGGGGCAGTGTTTCTGGAAGGAGTTCTAGGATGGGATGACTTGCTTTGG
GCCACTATATAGTGCTCATATATGGTAGTGCAATAGTTGCCATTATAAGTTGTTTCGAACTTTAATGCTCCTGAAAT
TCCCATGCAAGTATTTAGAGCTTCATATCCTACAAAAAGACAGGAAACGAGACCTTGAAAAAGACTCAGTACCAGA
AGGCATCCACTTATTGATTGCTTTTATACTTGCAACATGAAGGAAGCACGCTTTCTCACCAAAAAAAAAA f. Event 5 Exon 3 sequence GTGGTCATTAATTGCAGGTAGGCTTCCAGGCAGGACAGCAAATGACATCAAGAACTACTGGAACACTCAC
CTGGGCAAGAAAGTAGAAGTTGAAAACAAGAAGGCGGAGCCCAGTGCTGATGCCAAAGTAATTAAGCCAC
GGCCATGGAAAGTACCGTTGCAATGGTTTTGGTCAGAAGATCAGCAATCATGTGGAAGCCAGCAGCCGCA
AGAAGATTAATGCTTTGGGCCACTATATAGTGCTTATATATGGGATGACTTGCTTTGGGCCACTATATAG
TGCTTATATATGGTAGTGCAATAG

Figure: Alignment of Wild Type and Five Mutant Alleles

```
RTPAP1_mrna    0  ATGGGTAATTTGCGTGCCGAAGTCCAACGTCCAGCTGGTGTTCGCAAAGG
       SNP_1   0  ATGGGTAATTTGCGTGCCGAAGTCCAACGTCCAGCTGGTGTTCGCAAAGG
       SNP_2   0  ATGGGTAATTTGCGTGCCGAAGTCCAACGTCCAGCTGGTGTTCGCAAAGG
       SNP_3   0  ATGGGTAATTTGCGTGCCGAAGTCCAACGTCCAGCTGGTGTTCGCAAAGG
       SNP_4   0  ATGGGTAATTTGCGTGCCGAAGTCCAACGTCCAGCTGGTGTTCGCAAAGG
       SNP_5   0  ATGGGTAATTTGCGTGCCGAAGTCCAACGTCCAGCTGGTGTTCGCAAAGG
RTPAP1_mrnaAA  0  MetGlyAsnLeuArgAlaGluValGlnArgProAlaGlyValArgLysGl
     SNP_1AA   0  MetGlyAsnLeuArgAlaGluValGlnArgProAlaGlyValArgLysGl
     SNP_2AA   0  MetGlyAsnLeuArgAlaGluValGlnArgProAlaGlyValArgLysGl
     SNP_3AA   0  MetGlyAsnLeuArgAlaGluValGlnArgProAlaGlyValArgLysGl
     SNP_4AA   0  MetGlyAsnLeuArgAlaGluValGlnArgProAlaGlyValArgLysGl
     SNP_5AA   0  MetGlyAsnLeuArgAlaGluValGlnArgProAlaGlyValArgLysGl
                  |---------|---------|---------|---------|---------
                  1         11        21        31        41

RTPAP1_mrna   50  AGCATGGAGTGAAGAGGAGGACAGGCTTCTGAGAAAGTGCGTTGAGAAAT
       SNP_1  50  AGCATGGAGTGAAGAGGAGGACAGGCTTCTGAGAAAGTGCGTTGAGAAAT
       SNP_2  50  AGCATGGAGTGAAGAGGAGGACAGGCTTCTGAGAAAGTGCGTTGAGAAAT
       SNP_3  50  AGCATGGAGTGAAGAGGAGGACAGGCTTCTGAGAAAGTGCGTTGAGAAAT
       SNP_4  50  AGCATGGAGTGAAGAGGAGGACAGGCTTCTGAGAAAGTGCGTTGAGAAAT
       SNP_5  50  AGCATGGAGTGAAGAGGAGGACAGGCTTCTGAGAAAGTGCGTTGAGAAAT
RTPAP1_mrnaAA 50  yAlaTrpSerGluGluGluAspArgLeuLeuArgLysCysValGluLysT
     SNP_1AA  50  yAlaTrpSerGluGluGluAspArgLeuLeuArgLysCysValGluLysT
     SNP_2AA  50  yAlaTrpSerGluGluGluAspArgLeuLeuArgLysCysValGluLysT
     SNP_3AA  50  yAlaTrpSerGluGluGluAspArgLeuLeuArgLysCysValGluLysT
     SNP_4AA  50  yAlaTrpSerGluGluGluAspArgLeuLeuArgLysCysValGluLysT
     SNP_5AA  50  yAlaTrpSerGluGluGluAspArgLeuLeuArgLysCysValGluLysT
                  |---------|---------|---------|---------|---------
                  51        61        71        81        91

RTPAP1_mrna  100  ATGGCGAAGGGAACTGGCGCCATGTTCCCCAAAGGGCAGGCCTCAGAAGG
       SNP_1 100  ATGGCGAAGGGAACTGGCGCCATGTTCCCCAAAGGGCAGGCCTCAGAAGG
       SNP_2 100  ATGGCGAAGGGAACTGGCGCCATGTTCCCCAAAGGGCAGGCCTCAGAAGG
       SNP_3 100  ATGGCGAAGGGAACTGGCGCCATGTTCCCCAAAGGGCAGGCCTCAGAAGG
       SNP_4 100  ATGGCGAAGGGAACTGGCGCCATGTTCCCCAAAGGGCAGGCCTCAGAAGG
       SNP_5 100  ATGGCGAAGGGAACTGGCGCCATGTTCCCCAAAGGGCAGGCCTCAGAAGG
RTPAP1_mrnaAA 100 yrGlyGluGlyAsnTrpArgHisValProGlnArgAlaGlyLeuArgArg
     SNP_1AA 100  yrGlyGluGlyAsnTrpArgHisValProGlnArgAlaGlyLeuArgArg
     SNP_2AA 100  yrGlyGluGlyAsnTrpArgHisValProGlnArgAlaGlyLeuArgArg
     SNP_3AA 100  yrGlyGluGlyAsnTrpArgHisValProGlnArgAlaGlyLeuArgArg
     SNP_4AA 100  yrGlyGluGlyAsnTrpArgHisValProGlnArgAlaGlyLeuArgArg
     SNP_5AA 100  yrGlyGluGlyAsnTrpArgHisValProGlnArgAlaGlyLeuArgArg
                  |---------|---------|---------|---------|---------
                  101       111       121       131       141

RTPAP1_mrna  150  TGCCGAAAGAGCTGCCGACTACGGTGGTTGAACTATCTCAGCCCTAGGAT
       SNP_1 150  TGCCGAAAGAGCTGCCGACTACGGTGGTTGAACTATCTCAGCCCTAGGAT
       SNP_2 150  TGCCGAAAGAGCTGCCGACTACGGTGGTTGAACTATCTCAGCCCTAGGAT
       SNP_3 150  TGCCGAAAGAGCTGCCGACTACGGTGGTTGAACTATCTCAGCCCTAGGAT
       SNP_4 150  TGCCGAAAGAGCTGCCGACTACGGTGGTTGAACTATCTCAGCCCTAGGAT
       SNP_5 150  TGCCGAAAGAGCTGCCGACTACGGTGGTTGAACTATCTCAGCCCTAGGAT
RTPAP1_mrnaAA 150 CysArgLysSerCysArgLeuArgTrpLeuAsnTyrLeuSerProArgIl
     SNP_1AA 150  CysArgLysSerCysArgLeuArgTrpLeuAsnTyrLeuSerProArgIl
     SNP_2AA 150  CysArgLysSerCysArgLeuArgTrpLeuAsnTyrLeuSerProArgIl
     SNP_3AA 150  CysArgLysSerCysArgLeuArgTrpLeuAsnTyrLeuSerProArgIl
     SNP_4AA 150  CysArgLysSerCysArgLeuArgTrpLeuAsnTyrLeuSerProArgIl
     SNP_5AA 150  CysArgLysSerCysArgLeuArgTrpLeuAsnTyrLeuSerProArgIl
                  |---------|---------|---------|---------|---------
                  151       161       171       181       191
```

*FIG. 11*

```
RTPAP1_mrna    200 CAACAGGGAGAAATTTTCGGAGGAAGAAACAGATCTTATCATCAGGCTTC
     SNP_1     200 CAACAGGGAGAAATTTTCGGAGGAAGAAACAGATCTTATCATCAGGCTTC
     SNP_2     200 CAACAGGGAGAAATTTTCGGAGGAAGAAACAGATCTTATCATCAGGCTTC
     SNP_3     200 CAACAGGGAGAAATTTTCGGAGGAAGAAACAGATCTTATCATCAGGCTTC
     SNP_4     200 CAACAGGGAGAAATTTTCGGAGGAAGAAACAGATCTTATCATCAGGCTTC
     SNP_5     200 CAACAGGGAGAAATTTTCGGAGGAAGAAACAGATCTTATCATCAGGCTTC
RTPAP1_mrnaAA  200 eAsnArgGluLysPheSerGluGluGluThrAspLeuIleIleArgLeuH
     SNP_1AA   200 eAsnArgGluLysPheSerGluGluGluThrAspLeuIleIleArgLeuH
     SNP_2AA   200 eAsnArgGluLysPheSerGluGluGluThrAspLeuIleIleArgLeuH
     SNP_3AA   200 eAsnArgGluLysPheSerGluGluGluThrAspLeuIleIleArgLeuH
     SNP_4AA   200 eAsnArgGluLysPheSerGluGluGluThrAspLeuIleIleArgLeuH
     SNP_5AA   200 eAsnArgGluLysPheSerGluGluGluThrAspLeuIleIleArgLeuH
                   |---------|---------|---------|---------|---------
                   201       211       221       231       241

RTPAP1_mrna    250 ATAAGCTCTTGGGCAACAGGTGGTCATTAATTGCAGGTAGGCTTCCAGGC
     SNP_1     250 ATAAGCTCTTGGGCAACAGGTGGTCATTAATTGCAGGTAGGCTTCCAGGC
     SNP_2     250 ATAAGCTCTTGGGCAACAGGTGGTCATTAATTGCAGGTAGGCTTCCAGGC
     SNP_3     250 ATAAGCTCTTGGGCAACAGGTGGTCATTAATTGCAGGTAGGCTTCCAGGC
     SNP_4     250 ATAAGCTCTTGGGCAACAGGTGGTCATTAATTGCAGGTAGGCTTCCAGGC
     SNP_5     250 ATAAGCTCTTGGGCAACAGGTGGTCATTAATTGCAGGTAGGCTTCCAGGC
RTPAP1_mrnaAA  250 isLysLeuLeuGlyAsnArgTrpSerLeuIleAlaGlyArgLeuProGly
     SNP_1AA   250 isLysLeuLeuGlyAsnArgTrpSerLeuIleAlaGlyArgLeuProGly
     SNP_2AA   250 isLysLeuLeuGlyAsnArgTrpSerLeuIleAlaGlyArgLeuProGly
     SNP_3AA   250 isLysLeuLeuGlyAsnArgTrpSerLeuIleAlaGlyArgLeuProGly
     SNP_4AA   250 isLysLeuLeuGlyAsnArgTrpSerLeuIleAlaGlyArgLeuProGly
     SNP_5AA   250 isLysLeuLeuGlyAsnArgTrpSerLeuIleAlaGlyArgLeuProGly
                   |---------|---------|---------|---------|---------
                   251       261       271       281       291

RTPAP1_mrna    300 AGGACAGCAAATGACATCAAGAACTACTGGAACACTCACCTGGGCAAGAA
     SNP_1     300 AGGACAGCAAATGACATCAAGAACTACTGGAACACTCACCTGGGCAAGAA
     SNP_2     300 AGGACAGCAAATGACATCAAGAACTACTGGAACACTCACCTGGGCAAGAA
     SNP_3     300 AGGACAGCAAATGACATCAAGAACTACTGGAACACTCACCTGGGCAAGAA
     SNP_4     300 AGGACAGCAAATGACATCAAGAACTACTGGAACACTCACCTGGGCAAGAA
     SNP_5     300 AGGACAGCAAATGACATCAAGAACTACTGGAACACTCACCTGGGCAAGAA
RTPAP1_mrnaAA  300 ArgThrAlaAsnAspIleLysAsnTyrTrpAsnThrHisLeuGlyLysLy
     SNP_1AA   300 ArgThrAlaAsnAspIleLysAsnTyrTrpAsnThrHisLeuGlyLysLy
     SNP_2AA   300 ArgThrAlaAsnAspIleLysAsnTyrTrpAsnThrHisLeuGlyLysLy
     SNP_3AA   300 ArgThrAlaAsnAspIleLysAsnTyrTrpAsnThrHisLeuGlyLysLy
     SNP_4AA   300 ArgThrAlaAsnAspIleLysAsnTyrTrpAsnThrHisLeuGlyLysLy
     SNP_5AA   300 ArgThrAlaAsnAspIleLysAsnTyrTrpAsnThrHisLeuGlyLysLy
                   |---------|---------|---------|---------|---------
                   301       311       321       331       341

RTPAP1_mrna    350 AGTAGAAGTTGAAAACAAGAAGGCGGAGCCCAGTGCTGATGCCAAAGTAA
     SNP_1     350 AGTAGAAGTTGAAAACAAGAAGGCGGAGCCCAGTGCTGATGCCAAAGTAA
     SNP_2     350 AGTAGAAGTTGAAAACAAGAAGGCGGAGCCCAGTGCTGATGCCAAAGTAA
     SNP_3     350 AGTAGAAGTTGAAAACAAGAAGGCGGAGCCCAGTGCTGATGCCAAAGTAA
     SNP_4     350 AGTAGAAGTTGAAAACAAGAAGGCGGAGCCCAGTGCTGATGCCAAAGTAA
     SNP_5     350 AGTAGAAGTTGAAAACAAGAAGGCGGAGCCCAGTGCTGATGCCAAAGTAA
RTPAP1_mrnaAA  350 sValGluValGluAsnLysLysAlaGluProSerAlaAspAlaLysValI
     SNP_1AA   350 sValGluValGluAsnLysLysAlaGluProSerAlaAspAlaLysValI
     SNP_2AA   350 sValGluValGluAsnLysLysAlaGluProSerAlaAspAlaLysValI
     SNP_3AA   350 sValGluValGluAsnLysLysAlaGluProSerAlaAspAlaLysValI
     SNP_4AA   350 sValGluValGluAsnLysLysAlaGluProSerAlaAspAlaLysValI
     SNP_5AA   350 sValGluValGluAsnLysLysAlaGluProSerAlaAspAlaLysValI
                   |---------|---------|---------|---------|---------
                   351       361       371       381       391
```

*FIG. 11 (cont'd)*

```
RTPAP1_mrna    400 TTAAGCCACGGCCATGGAAAGTACCGTTGCAATGGTTATGGTCAGAAGAT
SNP_1          400 TTAAGCCACGGCCATGGAAAGTACCGTTGCAATGGTTATGGTCAGAAGAT
SNP_2          400 TTAAGCCACGGCCATGGAAAGTACCGTTGCAATGGTTATGGTCAGAAGAT
SNP_3          400 TTAAGCCACGGCCATGGAAAGTACCGTTGCAATGGTTATGGTCAGAAGAT
SNP_4          400 TTAAGCCACGGCCATGGAAAGTACCGTTGCAATGGTTATGGTCAGAAGAT
SNP_5          400 TTAAGCCACGGCCATGGAAAGTACCGTTGCAATGGTTATGGTCAGAAGAT
RTPAP1_mrnaAA  400 leLysProArgProTrpLysValProLeuGlnTrpLeuTrpSerGluAsp
SNP_1AA        400 leLysProArgProTrpLysValProLeuGlnTrpLeuTrpSerGluAsp
SNP_2AA        400 leLysProArgProTrpLysValProLeuGlnTrpLeuTrpSerGluAsp
SNP_3AA        400 leLysProArgProTrpLysValProLeuGlnTrpLeuTrpSerGluAsp
SNP_4AA        400 leLysProArgProTrpLysValProLeuGlnTrpLeuTrpSerGluAsp
SNP_5AA        400 leLysProArgProTrpLysValProLeuGlnTrpLeuTrpSerGluAsp
                   |---------|---------|---------|---------|------
                   401       411       421       431       441

RTPAP1_mrna    450 CAGCAATCATGTGGAAGCCAGCAGCCGCAAGAAAAGTTTGGGATACCAGA
SNP_1          450 CAGCAATCATGTGGAAGCCAGCAGCCGCAAGAAAAGTTTGGGATACCAGA
SNP_2          450 CAGCAATCATGTGGAAGCCAGCAGCCGCAAGAAAAGTTTGGGATACCAGA
SNP_3          450 CAGCAATCATGTGGAAGCCAGCAGCCGCAAGAAAAGTTTGGGATACCAGA
SNP_4          450 CAGCAATCATGTGGAAGCCAGCAGCCGCAAGAAAAGTTTGGGATACCAGA
SNP_5          450 CAGCAATCATGTGGAAGCCAGCAGCCGCAAGAA------------GAT---------
RTPAP1_mrnaAA  450 GlnGlnSerCysGlySerGlnGlnProGlnGluLysPheGlyIleProGl
SNP_1AA        450 GlnGlnSerCysGlySerGlnGlnProGlnGluLysPheGlyIleProGl
SNP_2AA        450 GlnGlnSerCysGlySerGlnGlnProGlnGluLysPheGlyIleProGl
SNP_3AA        450 GlnGlnSerCysGlySerGlnGlnProGlnGluLysPheGlyIleProGl
SNP_4AA        450 GlnGlnSerCysGlySerGlnGlnProGlnGluLysPheGlyIleProGl
SNP_5AA        450 GlnGlnSerCysGlySerGlnGlnProGlnGluAspTer
                   |---------|---------|---------|---------|------
                   451       461       471       481       491

RTPAP1_mrna    500 ACTACCGACAATCTCAGAGAACGATGAAGCGTGGCTGAATTGTATAATGA
SNP_1          500 ACTACCGACAATCTCAGAGAACGATGAAGCGTGGCTGAATTGTATAATGA
SNP_2          500 ACTACCGACAATCTCAGAGAACGATGAAGCGTGGCTGAATTGTATAATGA
SNP_3          500 ACTACCGACAATCTCAGAGAACGATGAAGCGTaGCTGAATTGTATAATGA
SNP_4          500 ACTACCGACAATCTCAGAGAACGATGAAGCGTGGCTGAATTGTA--ATGA
SNP_5          486 ------------------------------------------TAATG--
RTPAP1_mrnaAA  500 uLeuProThrIleSerGluAsnAspGluAlaTrpLeuAsnCysIleMetA
SNP_1AA        500 uLeuProThrIleSerGluAsnAspGluAlaTrpLeuAsnCysIleMetA
SNP_2AA        500 uLeuProThrIleSerGluAsnAspGluAlaTrpLeuAsnCysIleMetA
SNP_3AA        500 uLeuProThrIleSerGluAsnAspGluAlaTer
SNP_4AA        500 uLeuProThrIleSerGluAsnAspGluAlaTrpLeuAsnCys**Asn-Gl**
SNP_5AA        486
                   |---------|---------|---------|---------|------
                   501       511       521       531       541

RTPAP1_mrna    550 ATGGAGATAGAGAGAACAGTGCAGTGCCAGACGTTGGAAACGGGAGCACA
SNP_1          550 ATGGAGATAGAGAGAACAGTGCAGTGCCAGACGTTGGAAACGGGAGCACA
SNP_2          550 ATGGAGATAGAGAGAACAGTGCAGTGCCAGACGTTGGAAACGGGAGCACA
SNP_3          550 ATGGAGATAGAGAGAACAGTGCAGTGCCAGACGTTGGAAACGGGAGCACA
SNP_4          548 ATGGAGATAGAGAGAACAGTGCAGTGCCAGACGTTGGAAACGGGAGCACA
SNP_5          491 -------------------------------CtTTGGGC-------CACt
RTPAP1_mrnaAA  550 snGlyAspArgGluAsnSerAlaValProAspValGlyAsnGlySerThr
SNP_1AA        550 snGlyAspArgGluAsnSerAlaValProAspValGlyAsnGlySerThr
SNP_2AA        550 snGlyAspArgGluAsnSerAlaValProAspValGlyAsnGlySerThr
SNP_3AA        550
SNP_4AA        548 uTrpArgTer
SNP_5AA        491
                   |---------|---------|---------|---------|------
                   551       561       571       581       591
```

*FIG. 11 (cont'd)*

```
RTPAP1_mrna    600 ATGAACCTGCAGAATGAATTTGGAATCGGAGGCTTGGAGGAAAATAGAGA
      SNP_1    600 ATGAACCTGCAGAATGAATTTGGAATCGGAGGCTTGGAGGAAAATtGAGA
      SNP_2    600 ATGAACCTGCAGAATtAATTTGGAATCGGAGGCTTGGAGGAAAATAGAGA
      SNP_3    600 ATGAACCTGCAGAATGAATTTGGAATCGGAGGCTTGGAGGAAAATAGAGA
      SNP_4    598 ATGAACCTGCAGAATGAATTTGGAATCGGAGGCTTGGAGGAAAATAGAGA
      SNP_5    503 ATa-----------------------------------------------
RTPAP1_mrnaAA  600 MetAsnLeuGlnAsnGluPheGlyIleGlyGlyLeuGluGluAsnArgAs
     SNP_1AA   600 MetAsnLeuGlnAsnGluPheGlyIleGlyGlyLeuGluGluAsnTer
     SNP_2AA   600 MetAsnLeuGlnAsnTer
     SNP_3AA   600
     SNP_4AA   598
     SNP_5AA   503

|---------|---------|---------|---------|---------
                   601       611       621       631       641

RTPAP1_mrna    650 TGGGGCAGTGTTTCTGGAAGGAGTTCTAGGATGGGATGACTTGCTTTGGG
      SNP_1    650 TGGGGCAGTGTTTCTGGAAGGAGTTCTAGGATGGGATGACTTGCTTTGGG
      SNP_2    650 TGGGGCAGTGTTTCTGGAAGGAGTTCTAGGATGGGATGACTTGCTTTGGG
      SNP_3    650 TGGGGCAGTGTTTCTGGAAGGAGTTCTAGGATGGGATGACTTGCTTTGGG
      SNP_4    648 TGGGGCAGTGTTTCTGGAAGGAGTTCTAGGATGGGATGACTTGCTTTGGG
      SNP_5    506 --------tAGTGcTTaTatA-------------TGGGATGACTTGCTTTGGG
RTPAP1_mrnaAA  650 pGlyAlaValPheLeuGluGlyValLeuGlyTrpAspAspLeuLeuTrpA
     SNP_1AA   650
     SNP_2AA   650
     SNP_3AA   650
     SNP_4AA   648
     SNP_5AA   506

|---------|---------|---------|---------|---------
                   651       661       671       681       691

RTPAP1_mrna    700 CCACTATATAGTGCTCATATATGGTAGTGCAATAGTTGCCATTATAAGTT
      SNP_1    700 CCACTATATAGTGCTCATATATGGTAGTGCAATAGTTGCCATTATAAGTT
      SNP_2    700 CCACTATATAGTGCTCATATATGGTAGTGCAATAGTTGCCATTATAAGTT
      SNP_3    700 CCACTATATAGTGCTCATATATGGTAGTGCAATAGTTGCCATTATAAGTT
      SNP_4    698 CCACTATATAGTGCTCATATATGGTAGTGCAATAGTTGCCATTATAAGTT
      SNP_5    538 CCACTATATAGTGCTtATATATGGTAGTGCAATAGTTGCCATTATAAGTT
RTPAP1_mrnaAA  700 laThrIleTer
     SNP_1AA   700
     SNP_2AA   700
     SNP_3AA   700
     SNP_4AA   698
     SNP_5AA   538

|---------|---------|---------|---------|---------
                   701       711       721       731       741

RTPAP1_mrna    750 GTTTCGAACTTTAATGCTCCTGAAATTCCCATGCAAGTATTTAGAGCTTC
      SNP_1    750 GTTTCGAACTTTAATGCTCCTGAAATTCCCATGCAAGTATTTAGAGCTTC
      SNP_2    750 GTTTCGAACTTTAATGCTCCTGAAATTCCCATGCAAGTATTTAGAGCTTC
      SNP_3    750 GTTTCGAACTTTAATGCTCCTGAAATTCCCATGCAAGTATTTAGAGCTTC
      SNP_4    748 GTTTCGAACTTTAATGCTCCTGAAATTCCCATGCAAGTATTTAGAGCTTC
      SNP_5    588 GTTTCGAACTTTAATGCTCCTGAAATTCCCATGCAAGTATTTAGAGCTTC
RTPAP1_mrnaAA  750
     SNP_1AA   750
     SNP_2AA   750
     SNP_3AA   750
     SNP_4AA   748
     SNP_5AA   588

|---------|---------|---------|---------|---------
                   751       761       771       781       791
```

*FIG. 11 (cont'd)*

```
RTPAP1_mrna    800 ATATCCTACAAAAAGACAGGAAACGAGACCTTGAAAAAAGACTCAGTACC
      SNP_1    800 ATATCCTACAAAAAGACAGGAAACGAGACCTTGAAAAAAGACTCAGTACC
      SNP_2    800 ATATCCTACAAAAAGACAGGAAACGAGACCTTGAAAAAAGACTCAGTACC
      SNP_3    800 ATATCCTACAAAAAGACAGGAAACGAGACCTTGAAAAAAGACTCAGTACC
      SNP_4    798 ATATCCTACAAAAAGACAGGAAACGAGACCTTGAAAAAAGACTCAGTACC
      SNP_5    638 ATATCCTACAAAAAGACAGGAAACGAGACCTTGAAAAAAGACTCAGTACC
RTPAP1_mrnaAA  800
    SNP_1AA    800
    SNP_2AA    800
    SNP_3AA    800
    SNP_4AA    798
    SNP_5AA    638
                   |---------|---------|---------|---------|---------
                  801       811       821       831       841

RTPAP1_mrna    850 AGAAGGCATCCACTTATTGATTGCTTTTATACTTGCAACATGAAGGAAGC
      SNP_1    850 AGAAGGCATCCACTTATTGATTGCTTTTATACTTGCAACATGAAGGAAGC
      SNP_2    850 AGAAGGCATCCACTTATTGATTGCTTTTATACTTGCAACATGAAGGAAGC
      SNP_3    850 AGAAGGCATCCACTTATTGATTGCTTTTATACTTGCAACATGAAGGAAGC
      SNP_4    848 AGAAGGCATCCACTTATTGATTGCTTTTATACTTGCAACATGAAGGAAGC
      SNP_5    688 AGAAGGCATCCACTTATTGATTGCTTTTATACTTGCAACATGAAGGAAGC
RTPAP1_mrnaAA  850
    SNP_1AA    850
    SNP_2AA    850
    SNP_3AA    850
    SNP_4AA    848
    SNP_5AA    688
                   |---------|---------|---------|---------|---------
                  851       861       871       881       891

RTPAP1_mrna    900 ACGCTTTCTCACCAAAAAAAAAA
      SNP_1    900 ACGCTTTCTCACCAAAAAAAAAA
      SNP_2    900 ACGCTTTCTCACCAAAAAAAAAA
      SNP_3    900 ACGCTTTCTCACCAAAAAAAAAA
      SNP_4    898 ACGCTTTCTCACCAAAAAAAAAA
      SNP_5    738 ACGCTTTCTCACCAAAAAAAAAA
RTPAP1_mrnaAA  900
    SNP_1AA    900
    SNP_2AA    900
    SNP_3AA    900
    SNP_4AA    898
    SNP_5AA    738
                   |---------|---------|---------
                  901       911       921
```

*FIG. 11 (cont'd)* a.
5' AACTACCGACAATCTCTCAGAGAACGATGAAGCCGTgGCTGAATTGTATAATGAATGGAGATAGAGAGAACAG 3'
3' ←FAMC 5' b.
5' AACTACCGACAATCTCTCAGAGAACGATGAAGCCGTaGCTGAATTGTATAATGAATGGAGATAGAGAGAACAG 3'
3' ←TAMT 5'

*FIG. 15*

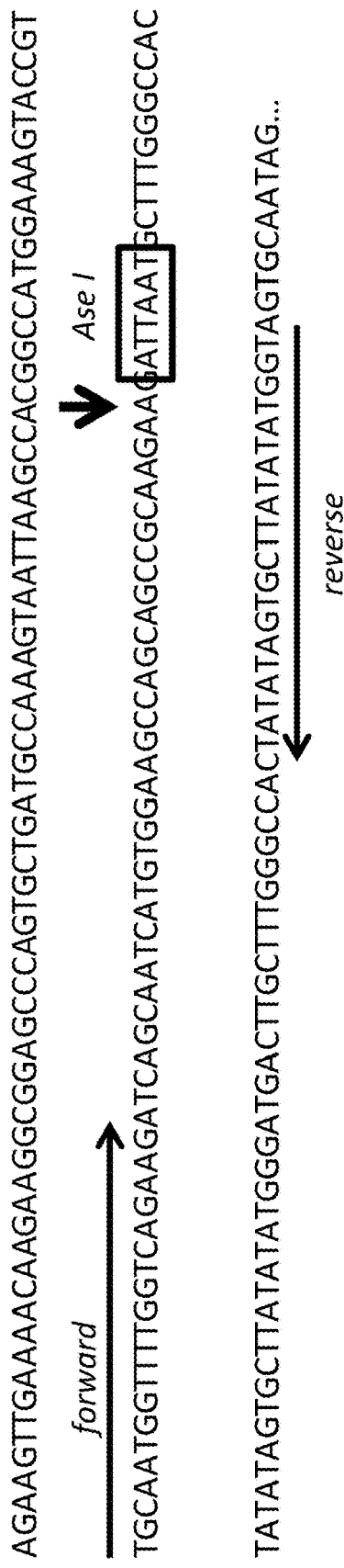
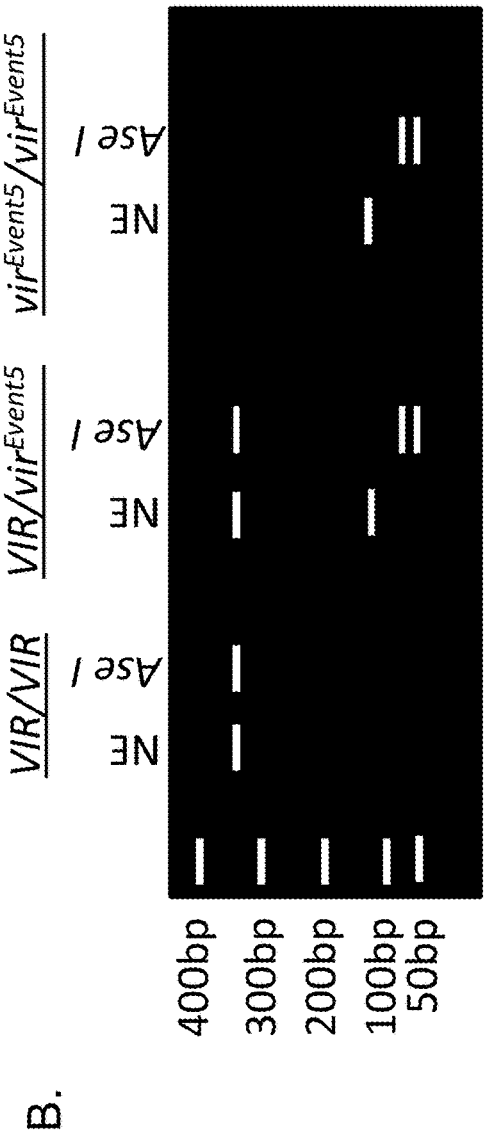
FIG. 16

GENE CONTROLLING FRUIT COLOR PHENOTYPE IN PALM

CROSS-REFERENCE TO RELATED APPLICATIONS

The present patent application claims benefit of priority to U.S. Provisional Patent Application No. 61/809,767, filed on Apr. 8, 2013, which is incorporated by reference.

BACKGROUND OF THE INVENTION

The oil palm (*Elaeis guineensis* Jacq.) is the main source of vegetable oil in the world and is currently one of the most important crops planted in South East Asia, Africa and South America. The demand for palm oil is high and it has risen steadily for the past decade. As such it is desirable to identify traits that can be exploited to improve palm oil yield. However, the long selection cycle (10-12 years) for oil palm makes traditional breeding programs inefficient at providing improved planting material within a reasonable time frame.

One important trait related to palm oil production is the skin colour of the fruit. The skin color of the fruit of the oil palm can vary considerably based on external appearance, (FIG. 1). By far the most common type of fruit is deep violet to black at the apex and whitish-yellow at the base when unripe. Such a fruit has been described as *nigrescens* (Hartley, C. In: *The Oil Palm*. 47-94 (Longman, 1988)). The color of the *nigrescens* fruit varies to some extent on ripening, to either entirely red, or black over the upper half but red at the base (Hartley, C. In: *The Oil Palm*. 47-94 (Longman, 1988)). Harvesters of *nigrescens* oil palm fruit have to rely solely on the presence of loose fruits on the ground, detached from the oil palm bunch, to determine that the bunch containing the fruits is ready for harvest. The collection of loose fruits is labor intensive and can occupy up to 28% of the total harvesting time (Hitam, A. et al. In: *Proceedings of the 1999 PORIM International Palm Oil Congress (PIPOC)*— Emerging technologies and opportunities in the next millennium, ed. A. Darus, C. K. Weng, and S. S. R. S. Alwee, pp 325-336, Palm Oil Research Institute of Malaysia (PORIM), Bangi, Malaysia.). Indeed, difficulty with loose fruit collection is considered a significant contributor to the decline of oil extraction rates (OER) observed in Malaysian Plantations (Corley and Law, Planter, 77: 507-524 (2001)).

The other major fruit type is known as *virescens*, which is green before ripening and changes at maturity to light-reddish-orange in colour. Inheritance studies indicate that the *virescens* trait is controlled by a single gene (monogenic) and dominant (Corley and Tinker. In: *The Oil Palm* 4$^{th}$ edn, 287-325 (Blackwell Science, 2003))). Generally, fresh fruit bunch (FFB) yields of more than 30 tons/ha, with oil/bunch ranging from 29-30%, have been reported in progeny testing involving *virescens* palms (Wahid and Rajanaidu. Oil Palm Breeding and Competitive approaches. Agriculture Biotechnology International Conference (ABIC), 12-15 September, 2004. Cologne, Germany.) and the yield profile is similar to *nigrescens* palms.

Both the *nigrescens* and *virescens* fruits occur in wild-type oil palm populations. However, although the *virescens* trait is dominant, the number of *virescens* palms found in natural populations is small, perhaps suggesting that they have been selected against by farmers or could have associated negative traits. In Nigeria for example only 50 of 10,000 bunches observed were *virescens*, while in Angola only 72 of 10,000 bunches observed were *virescens*, (Hartley, C. In: *The Oil Palm*. 47-94 (Longman, 1988)). However, as reported by Corley and Tinker (Corley and Tinker. In: *The Oil Palm* 4$^{th}$ edn, 287-325 (Blackwell Science, 200)3)), Rajanaidu found 6% *virescens* palms among his collections in Cameroon (Rajanaidu, N. In: ni Proc. Int. Workshop. "Oil palm germplasm and utilization". Palm Oil Res. Inst. Malaysia. 59-83 (1986)). Currently, commercial plantations primarily utilize *nigrescens* palms. However, *virescens*, palms can be more desirable to planters as the clear difference in colour between ripe and unripe bunches make it easier to identify ripe bunches, particularly in tall palms, where bunches can be obscured by fronds.

Traditional methods do not allow identification of the fruit type of a given plant until it has matured enough to produce a first batch of fruit, which typically takes approximately six years after germination. In plantations desirous of introducing *virescens* materials, significant land, labor, financial and energy resources are invested during the interval from germination to fruit production, some of which will ultimately be of the *nigrescens* fruit types. By the time *nigrescens* palms are identified, it is impractical to remove them from the field and replace them with *virescens* palms, and thus growers will have a mixture of both types of palm plants, which may affect yields for the 25 to 30 year production life of the plants due to inefficient identification of ripe *nigrescens* bunches. Similarly, the long selection cycle of 10-12 years from seed to seed makes it laborious to use traditional breeding methods to identify or develop true breeding strains of *virescens* palm oil.

BRIEF SUMMARY OF THE INVENTION

In some embodiments, the present invention provides method for determining a fruit color phenotype of a palm plant, the method comprising, providing a sample from a plant or seed; and detecting presence or absence of a VIR gene alteration in a genomic region corresponding to SEQ ID NO:1 that confers a *virescens* phenotype to fruit, or detecting a presence or absence of a genetic marker linked to the alteration within 2,000 kb of the genomic region, wherein the presence of the alteration or genetic marker predicts the presence of the *virescens* phenotype. In some cases, detection of the absence of the alteration or genetic marker predicts the presence of the *nigrescens* phenotype.

In some aspects the alteration comprises a nucleotide change that results in an encoded amino acid change, a splice site or other alteration resulting in a change in splicing, and/or a stop codon.

In some aspects the method comprises detecting the presence or absence of a VIR gene alteration in a genomic region corresponding to SEQ ID NO:1 that confers a *virescens* phenotype to fruit.

In some cases, the alteration comprises a premature stop codon so as to generate a truncated protein compared to SEQ ID) NO:4.

In some cases, alteration is a dominant negative mutation.

In some cases, the alteration is selected from the group corresponding to SEQ ID NOS:7, 9, 11, 13, or 15, or the alteration produces a VIR allele that encodes an amino acid sequence selected from the group consisting of SEQ ID NOS:5, 8, 10, 12, and 14.

In some aspects, the VIR gene encodes (i) a polypeptide substantially (e.g., at least 70, 75, 80, 85, 90, or 95%) identical or identical to SEQ ID NO:4 or (ii) a polypeptide comprising at least 100, 125, 150, 175, 200, or 225 contiguous amino acids that are substantially (e.g., at least 70, 75, 80, 85, 90, or 95%) identical or identical to to a corresponding fragment of the SEQ ID NO:4. For example, the polypeptide or polypeptide fragment could contain 0, 1, 2, 3, or 4 amino acid substitutions or deletions in comparison to SEQ ID NO:4.

In some aspects the method comprises detecting a presence or absence of a genetic marker linked to the alteration within 1, 10, 20, 50, 100, 200, 500, 1000 kb, or 2000 kb from the genomic region.

In some aspects, the plant is less than 5 years old, or less than one year old. In some aspects, the plant is an oil palm.

In some aspects, the method comprises selecting the plant or seed for cultivation if the plant is predicted to have the *virescens* phenotype.

In some aspects, the method comprises selecting the plant or seed for cultivation if the plant is predicted to have the *nigrescens* phenotype.

In some cases, the plant or seed is discarded if the plant or seed is not predicted to have the *virescens* phenotype.

In some cases, the plant or seed is discarded if the plant or seed is predicted to have the *virescens* phenotype.

In some cases, the method further comprises predicting a shell thickness phenotype by detecting the presence or absence of a nucleic acid sequence associated with a dura, *tenera*, or *pisifera* phenotype. In some cases, the shell thickness phenotype is predicted from the same sample as the fruit color phenotype. In some cases, the shell thickness phenotype is predicted by detecting the presence or absence of a polymorphism at or near the SHELL locus, or at or near the locus of a gene encoding a MADS box containing protein associated with a dura, *tenera*, or *pisifera* phenotype.

In some embodiments, the present invention provides a method for segregating a plurality of palm plants into different categories based on predicted fruit color phenotype, the method comprising, providing a sample from each plant in the plurality of plants; detecting a presence or absence of a VIR gene alteration in a genomic region corresponding to SEQ ID NO:1 that confers a *virescens* phenotype to fruit, or detecting a presence or absence of a genetic marker linked to the alteration within 2000 kb of the genomic region, wherein the presence of the alteration or genetic marker predicts the presence of the *virescens* phenotype; and segregating the plants into groups based on the predicted *virescens* phenotype of the plants. For example, plants can be segregated into one group predicted to have a *virescens* phenotype and segregated into a different group predicted to have a *nigrescens* phenotype.

In some aspects, the method comprises detecting the presence or absence of a VIR gene alteration in a genomic region corresponding to SEQ ID NO:1 that confers a *virescens* phenotype to fruit.

In some cases, the alteration comprises a premature stop codon so as to generate a truncated protein compared to SEQ ID NO:4.

In some cases, the alteration is a dominant negative mutation.

In some cases, the alteration produces a VIR allele that encodes an amino acid sequence selected from the group consisting of SEQ ID NOS:5, 8, 10, 12, and 14.

In some cases, VIR gene encodes (i) a polypeptide substantially (e.g., at least 70, 75, 80, 85, 90, or 95%) identical or identical to SEQ ID NO:4 or (ii) a polypeptide comprising at least 100, 125, 150, 175, 200, or 225 contiguous amino acids that are substantially (e.g., at least 70, 75, 80, 85, 90, or 95%) identical or identical to a corresponding fragment of SEQ ID NO:4. For example, the polypeptide or polypeptide fragment could contain 0, 1, 2, 3, or 4 amino acid substitutions or deletions in comparison to SEQ ID NO:4.

In some aspects, the method comprises detecting a presence or absence of a genetic marker linked to the alteration within 1, 10, 20, 50, 100, 200, 500, 1000, or 2000 kb from the genomic region.

In some aspects, the plant is less than 5 years old, or the plant is less than one year old.

In some aspects, the plant is an oil palm.

In some cases, the method further comprises predicting a shell thickness phenotype by detecting the presence or absence of a nucleic acid sequence associated with a dura, *tenera*, or *pisifera* phenotype. In some cases, the shell thickness phenotype is predicted from the same sample as the fruit color phenotype. In some cases, the shell thickness phenotype is predicted by detecting the presence or absence of a polymorphism at or near the SHELL locus, or at or near the locus of a gene encoding a MADS box containing protein associated with a dura, *tenera*, or *pisifera* phenotype.

In some embodiments, the present invention provides a method for determining a fruit color phenotype of a palm plant, the method comprising, providing a sample from a plant or seed; and detecting presence or absence of an alteration in a VIR polypeptide corresponding to SEQ ID NO:4 that confers a *virescens* phenotype to fruit, wherein the presence of the alteration predicts the presence of the *virescens* phenotype. In some cases, detection of the absence of the alteration predicts the presence of the *nigrescens* phenotype.

In some embodiments, the present invention provides a kit for determining the fruit color phenotype (e.g., *virescens* or *nigrescens*) of a palm plant, the kit comprising, one or more oligonucleotide primers or probes comprising: a sequence of at least 6 (or 8, 10, 12, 14, 16, 18, 20, 22, 24, or more) nucleotides of SEQ ID NO:17; and/or; a sequence 100% complementary to at least 6 (or 8, 10, 12, 14, 16, 18, 20, 22, 24, or more) nucleotides of SEQ ID NO:17.

In some aspects, the primer or probe specifically hybridizes to palm plant DNA and/or to SEQ ID NO:17.

In some aspects, the kit comprises one or more oligonucleotide primers or probes comprising: a sequence of at least 6 (or 8, 10, 12, 14, 16, 18, 20, 22, 24, or more) nucleotides of SEQ ID NO:1; and/or; a sequence 100% complementary to at least 6 (or 8, 10, 12, 14, 16, 18, 20, 22, 24, or more) nucleotides of SEQ ID NO:1.

In some aspects, the primer or probe specifically hybridizes to SEQ ID NO:1.

In some aspects, the primer or probe specifically hybridizes to an alteration in SEQ ID NO:1 indicating a *virescens* allele.

In some cases, the alteration is selected from the group corresponding to SEQ ID NOS:7, 9, 11, or 13, or the alteration produces a VIR allele that encodes an amino acid sequence selected from the group consisting of SEQ ID NOS:5, 8, 10, 12, and 14.

In some aspects, a detectable label is linked to the oligonucleotide.

In some cases, the detectable label is fluorescent.

In some aspects, the kit further comprises a polynucleotide comprising a sequence substantially (e.g., at least 70, 75, 80, 85, 90, 95, 97, 98, 99%) identical or identical to at least 100, 200, 300, 400, 500, 750, 1000 or more contiguous nucleotides of SEQ ID NO:17 or SEQ ID NO:1.

In some aspects, the kit further comprises palm genomic DINA.

In some cases, the kit further comprises one or more oligonucleotide primers or probes for predicting a shell thickness phenotype. In some cases, the kit further comprises one or more immunological binding reagents (e.g., peptides or peptide fragments) for predicting a shell thickness phenotype.

In some embodiments, the present invention provides isolated nucleic acid comprising a polynucleotide encoding a polypeptide comprising a sequence substantially (e.g., at least 70, 75, 80, 85, 90, 95, 97, 98, 99%) identical or identical to SEQ ID NO:4 or a polypeptide fragment comprising at least 100, 125, 150, 175, 200, or 225 contiguous amino acids that are substantially (e.g., at least 70, 75, 80, 85, 90, or 95%) identical or identical to a corresponding fragment of SEQ ID NO:4. For example, the polypeptide or polypeptide fragment could contain 0, 1, 2, 3, or 4 amino acid substitutions or deletions in comparison to SEQ ID NO:4.

In some embodiments, the present invention provides a plant comprising a heterologous expression cassette, the expression cassette comprising a heterologous promoter operably linked to a polynucleotide encoding (i) a polypeptide comprising a sequence substantially (e.g., at least 70, 75, 80, 85, 90, 95, 97, 98, 99%) identical or identical to SEQ ID NO:4 or (ii) a polypeptide comprising at least 100, 125, 150, 175, 200, or 225 contiguous amino acids that are substantially (e.g., at least 70, 75, 80, 85, 90, or 95%) identical to a corresponding fragment of SEQ ID NO:4.

For example, the polypeptide could contain 0, 1, 2, 3, or 4 amino acid substitutions or deletions in comparison to SEQ ID NO:4 or in comparison to at least 100, 125, 150, 175, 200, or 225 contiguous amino acids of SEQ ID NO:4.

In some aspects, the plant is a palm plant, or the plant is an oil palm plant.

In some aspects, the polypeptide comprises SEQ ID NO:4.

In some aspects, the plant is a *virescens* oil palm plant.

In some aspects, the plant is a *nigrescens* oil palm plant.

In some embodiments, the present invention provides an isolated nucleic acid comprising an expression cassette, the expression cassette comprising a heterologous promoter operably linked to a polynucleotide encoding a polypeptide comprising (i) a sequence substantially (e.g., at least 70, 75, 80, 85, 90, 95, 97, 98, 99%) identical or identical to SEQ ID NO:4 or (ii) a polypeptide comprising at least 100, 125, 150, 175, 200, or 225 contiguous amino acids that are substantially (e.g., at least 70, 75, 80, 85, 90, or 95%) identical or identical to a corresponding fragment of SEQ ID NO:4. For example, the polypeptide could contain 0, 1, 2, 3, or 4 amino acid substitutions or deletions in comparison to SEQ ID NO:4 or in comparison to at least 100, 125, 150, 175, 200, or 225 contiguous amino acids of SEQ ID NO:4.

In some embodiments, the present invention provides an isolated nucleic acid comprising an expression cassette comprising a promoter operably linked to a polynucleotide, which polynucleotide, when expressed in the plant, reduces expression of a VIR polypeptide in a plant (compared to a control plant lacking the expression cassette).

In some aspects, the polynucleotide comprises at least 20 contiguous nucleotides, or the complement thereof, of a nucleic acid encoding a VIR polypeptide (e.g., an endogenous nucleic acid) substantially (e.g., at least 70, 75, 80, 85, 90, 95, 97, 98, 99%) identical or identical to SEQ ID NO:4, such that expression of the polynucleotide in a plant inhibits expression of the endogenous VIR gene. In some aspects the polynucleotide has 0, 1, 2, 3, 4, 5 substitutions or deletions relative to at least 20 contiguous nucleotides of a nucleic acid (e.g., an endogenous nucleic acid) encoding SEQ ID NO:4, such that expression of the polynucleotide in a plant inhibits expression of the endogenous VIR gene.

In some aspects, the polynucleotide comprises at least 20, 30, 40, 50, 75, or 100 contiguous nucleotides, or the complement thereof, of SEQ ID NO:1 or SEQ ID NO:3.

In some cases, the polynucleotide encodes an siRNA, antisense polynucleotide, a microRNA, or a sense suppression nucleic acid, which when expressed in a plant suppresses expression of an endogenous VIR gene.

In some embodiments, the present invention provides a plant having a *virescens* phenotype, the plant comprising an expression cassette as described herein.

In some cases, the plant is a palm (e.g., oil palm) plant.

In some embodiments, the present invention provides an isolated nucleic acid comprising an expression cassette comprising a promoter operably linked to a polynucleotide encoding a polypeptide comprising an amino acid sequence substantially (e.g., at least 70, 75, 80, 85, 90, 95, 97, 98, 99%) identical or identical to at least 100, 125, 150, 175, 200, or 225 contiguous amino acids of SEQ ID NO:4 but lacking at least a corresponding 3' terminal portion (e.g., at least 10, 20, 30, 40, 50, 60, 70, 80, 90, 100, 110, 120, 130, 140, 150 carboxyl terminal amino acids) of SEQ ID NO:4.

In some aspects, the polypeptide comprises the polypeptide encoded by SEQ ID NOS:7, 9, 11, 13, or 15.

In some embodiments, the present invention provides a plant having a *virescens* phenotype, the plant comprising an expression cassette as described herein.

In some aspects, the plant is a palm (e.g., oil palm) plant.

In some embodiments, the present invention provides a method of making a plant as described herein, the method comprising introducing an expression cassette of the invention into a plant.

In some embodiments, the present invention provides a method of cultivating a plant of as described herein.

Other embodiments will be evident from reading the rest of the disclosure.

DEFINITIONS

A "polymorphic marker" refers to a genetic marker that distinguishes between at least two different alleles. Exemplary polymorphic markers include, but are not limited to, single nucleotide polymorphisms (SNPs), variable number of tandem repeat polymorphisms (VNTR), restriction fragment length polymorphisms, (RFLP), microsatellite markers, insertions or deletions in a DNA sequence (Indels) or simple sequence repeats of DNA sequence (SSRs).

A genomic region "corresponding to" a test sequence refers to a genomic DNA that aligns with the test sequence. It is generally expected that a plant genome will have only one genomic region (i.e., a locus represented by two alleles in a diploid plant) corresponding to the test sequence. To the extent more than one genomic region from a plant can be aligned to the test sequence, the "corresponding" genomic region is the genomic region with the highest percent of identical nucleotides. Sequence comparisons can be performed using any BLAST™ including BLAST™ 2.2 algorithm with default parameters, described in Altschul et al., *Nuc. Acids Res.* 25:3389-3402 (1977) and Altschul et al., *J. Mol. Biol.* 215:403-410 (1990), respectively.

As used herein, the terms "nucleic acid," "polynucleotide" and "oligonucleotide" refer to nucleic acid regions, nucleic acid segments, primers, probes, amplicons and oligomer fragments. The terms are not limited by length and are generic to linear polymers of polydeoxyribonucleotides (containing 2-deoxy-D-ribose), polyribonucleotides (containing D-ribose), and any other N-glycoside of a purine or pyrimidine base, or modified purine or pyrimidine bases.

These terms include double- and single-stranded DNA, as well as double- and single-stranded RNA.

A nucleic acid, polynucleotide or oligonucleotide can comprise, for example, phosphodiester linkages or modified linkages including, but not limited to phosphotriester, phosphoramidate, siloxane, carbonate, carboxymethylester, acetamidate, carbamate, thioether, bridged phosphoramidate, bridged methylene phosphonate, phosphorothioate, methylphosphonate, phosphorodithioate, bridged phosphorothioate or sulfone linkages, and combinations of such linkages.

A nucleic acid, polynucleotide or oligonucleotide can comprise the five biologically occurring bases (adenine, guanine, thymine, cytosine and uracil) and/or bases other than the five biologically occurring bases.

Optimal alignment of sequences for comparison may be conducted by the local homology algorithm of Smith and Waterman *Add. Apl. Math.* 2.482 (1981), by the homology alignment algorithm of Needleman and Wunsch *J. Mol. Biol.* 48:443 (1970), by the search for similarity method of Pearson and Lipman *Proc. Natl. Acad. Sci.* (*U.S.A.*) 85: 2444 (1988), by computerized implementations of these algorithms (GAP, BESTFIT, BLAST™, FASTA, and TFASTA in the Wisconsin Genetics Software Package, Genetics Computer Group (GCG), 575 Science Dr., Madison, Wis.), or by inspection.

"Percentage of sequence identity" is determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison and multiplying the result by 100 to yield the percentage of sequence identity.

The term "substantial identity" of polypeptide sequences means that a polypeptide comprises a sequence that has at least 75% sequence identity. Alternatively, percent identity can be any integer from 75% to 100%. Exemplary embodiments include at least: 75%, 80%, 85%, 90%, 95%, or 99% compared to a reference sequence using the programs described herein; preferably BLAST™ using standard parameters, as described below. One of skill will recognize that these values can be appropriately adjusted to determine identity of proteins encoded by two nucleotide sequences by taking into account codon degeneracy, amino acid similarity, reading frame positioning and the like. Polypeptides which are "substantially similar" share sequences as noted above except that residue positions which are not identical may differ by conservative amino acid changes. Conservative amino acid substitutions refer to the interchangeability of residues having similar side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulfur-containing side chains is cysteine and methionine. Preferred conservative amino acids substitution groups are: valine-leucine-isoleucine, phenylalanine-tyrosine, lysine-arginine, alanine-valine, aspartic acid-glutamic acid, and asparagine-glutamine.

Another indication that nucleotide sequences are substantially identical is if two molecules hybridize to each other, or a third nucleic acid, under stringent conditions. Stringent conditions are sequence dependent and will be different in different circumstances. Generally, stringent conditions are selected to be about 5° C. lower than the thermal melting point (Tm) for the specific sequence at a defined ionic strength and pH. The Tm is the temperature (under defined ionic strength and pH) at which 50% of the target sequence hybridizes to a perfectly matched probe. Typically, stringent conditions will be those in which the salt concentration is about 0.02 molar at pH 7 and the temperature is at least about 60° C.

A polypeptide region "corresponding to" a test sequence refers to an amino acid sequence that aligns with the test sequence. It is generally expected that a plant proteome will have only one polypeptide region (i.e., encoded by a locus represented by two alleles in a diploid plant) corresponding to the test sequence. To the extent more than one polypeptide region from a plant can be aligned to the test sequence, the "corresponding" polypeptide region is the polypeptide region with the highest percent of identical amino acids. Sequence comparisons can be performed using any BLAST™ including BLAST™ 2.2 algorithm with suitable parameters.

The term "promoter" or "regulatory element" refers to a region or sequence determinants located upstream or downstream from the start of transcription and which are involved in recognition and binding of RNA polymerase and other proteins to initiate transcription. Promoters need not be of plant origin, for example, promoters derived from plant viruses, such as the CaMV35S promoter, can be used.

The term "plant" includes whole plants, shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit (the mature ovary), plant tissue (e.g. vascular tissue, ground tissue, and the like) and cells (e.g. guard cells, egg cells, trichomes and the like), and progeny of same. The class of plants that can be used in the method of the invention is generally as broad as the class of higher and lower plants amenable to transformation techniques, including angiosperms (monocotyledonous and dicotyledonous plants), gymnosperms, ferns, and multicellular algae. It includes plants of a variety of ploidy levels, including aneuploid, polyploid, diploid, haploid and hemizygous.

An "expression cassette" refers to a nucleic acid construct, which when introduced into a host cell, results in transcription and/or translation of a RNA or polypeptide, respectively. Antisense constructs or sense constructs that are not or cannot be translated are expressly included by this definition.

The term "operably linked" refers to a functional linkage between a nucleic acid expression control sequence (such as a promoter, or array of transcription factor binding sites) and a second nucleic acid sequence, wherein the expression control sequence directs transcription of the nucleic acid corresponding to the second sequence.

A polynucleotide sequence is "heterologous to" an organism or a second polynucleotide sequence if it originates from a foreign species, or, if from the same species, is modified from its original form. For example, a heterologous promoter operably linked to a coding sequence refers to a promoter from a species different from that from which the coding sequence was derived, or, if from the same species, a promoter which is different from any naturally occurring allelic variants.

BRIEF DESCRIPTION OF THE DRAWINGS

FIG. 5: VIR gene sequences. a, Full cDNA sequence of wild-type (*nigrescens*) VIR (SEQ ID NO:20). The sequence of exon 3, in which VIR mutation Events 1 through 5 occur, is bolded and underlined. b, Exon 3 sequence including the Event 1 mutation (SEQ ID NO:21). The A-to-T nonsense mutation (lower case, bold) introduces the boxed stop codon. c, Exon 3 sequence including the Event 2 mutation (SEQ ID NO:22). The G-to-T nonsense mutation (lower case, bold) introduces the boxed stop codon. d, Exon 3 sequence including the Event 3 mutation (SEQ ID NO:23). The G-to-A nonsense mutation (lower case, bold) introduces the boxed stop codon. e, Exon 3 sequence including the Event 4 mutation (SEQ ID NO:24). The two-bp deletion (dashes) introduces the downstream boxed top codon. f, Exon 3 sequence including the Event 5 rearrangement (SEQ ID NO:25). The rearrangement introduces the boxed premature stop codon.

FIG. 9: Alignment of R2R3 MYB domains of various related MYB genes from several species (SEQ ID NOS:32-61). R2 and R3 domains of closely related MYB proteins were used to construct the phylogenetic tree shown in FIG. 8. The bar graph represents level of conservation. Abbreviations are as described in the legend of FIG. 8.

FIG. 11: Sequence alignment of wild-type and mutant VIR alleles (nucleotide sequences=SEQ ID NOS:62-67; amino acid sequences=SEQ ID NOS:4, 5, 8, 10, 12 and 14, respectively).

FIG. 15: Single nucleotide primer extension-based assay for genotyping the vir$^{Event3}$ allele, a, Depicts an exemplary primer (SEQ ID NO:80) and primer extension product (SEQ ID NO:81) for detecting the wild-type VIR allele (template=SEQ ID NO:79). The primer extension product contains a 3' cytosine nucleotide linked to a detectable fluorescein derivative, denoted as $^{FAM}$C. b, Depicts an exemplary primer (SEQ ID NO:80) and primer extension product (SEQ ID NO:83) for detecting the vir$^{Event3}$ allele (template=SEQ ID NO:82). The primer extension product contains a 3' thymine nucleotide linked to a detectable rhodamine derivative, denoted as $^{TAM}$T (TAMRA). Thus plants containing a VIR/VIR, VIR/vir$^{Event3}$, or vir$^{Event3}$/vir$^{Event3}$ genotype can be differentially detected.

FIG. 16: Restriction enzyme-based assay for genotyping the vir$^{Event5}$ allele. a, Depicts the AseI cleavage site present in the vir$^{Event5}$ allele (SEQ ID NO:84) and binding sites for forward (SEQ ID NO:85) and reverse (SEQ ID NO:86) amplification primers. b, Depicts the results from amplifying the region flanked by the forward and reverse primers denoted in a to produce an amplicon, digesting a portion of the amplicon with AseI, and separating both the digested portion and an undigested portion by gel electrophoresis to differentially detect plants containing a VIR/VIR$^{Event5}$, VIR/vir$^{Event5}$, or vir$^{Event5}$/vir$^{Event5}$ genotype.

DETAILED DESCRIPTION OF THE INVENTION

I. Introduction

Figure 1:
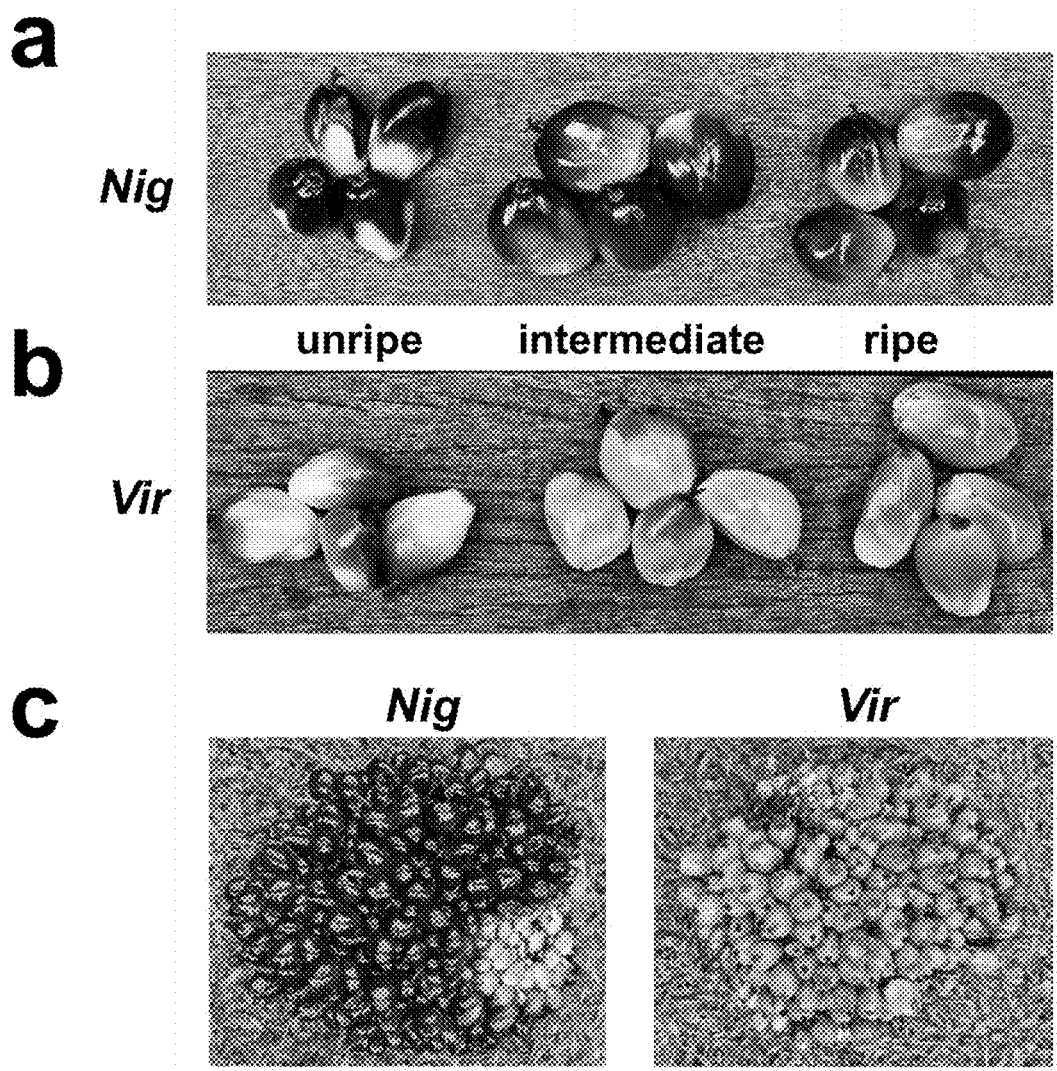
FIG. 1: Fruit exocarp colour phenotypes. a, Individual oil palm fruits from a *nigrescens* (Nig) fruit bunch. Unripe fruits are deep violet to black at the apex (visible in the bunch) and undergo minimal colour change upon ripening. b, Individual oil palm fruits from a *virescens* (Vir) fruit bunch. Unripe fruits are green at the apex and change to reddish orange upon ripening. c, ripe *nigrescens* and *virescens* fruit bunches.

The inventors have discovered the VIR gene, which is responsible for fruit color type and predicted to be a R2R3-Myb transcription factor. Truncations providing the *virescens* trait primarily deleted protein interaction domains and other regulatory domains, while leaving the DNA binding domain functionally intact. Thus, the truncated VIR genes can bind to, and sequester, transcription factor binding elements in the genome from wild-type VIR. These findings provide a genetic explanation for the monofactorial and dominant characteristics of the fruit color phenotype, and they have implications in oil palm breeding and commercial seed production.

The present disclosure describes the construction of a dense genetic map for a selfed palm, designated 1128 (0.151/128×0.151/128), from Malaysian Palm Oil Board's (MPOB) Nigerian germplasm collection (Rajanaidu, N. In: Proceedings of the 12th Plenary Meeting of Association for the Taxonomic Study of the flora of tropical Africa (AET-FAT), Mitteilingen Inst. Alig. Bet. Hamburg, Germany, pp 39-52 (1990); Chan, S. et al. In: Proceedings of the 1999 PORIM International Palm Oil Conference (eds Darus. K., Chan, K. W and Sharifah, S. R. S. A) Palm Oil Research Institute of Malaysia, pp 297-320 (1999)). A mapping population consisting of 240 palms was used for generating the genetic linkage map in this study. Six independent populations were also used to confirm the linkage of markers to the fruit color locus.

A polymorphic marker closely linked to the VIR gene, or the identification of the VIR gene itself and the use of a polymorphic marker located within the gene itself, is of significant use, as it can be used by seed producers as a quality control tool to i) reduce or eliminate *nigrescens* contamination of *virescens* seed or plantlets, and ii) positively identify *virescens* seeds or plantlets which are then selected as suitable planting material for commercial palm oil production. The identification of the VIR gene or a marker genetically linked to *virescens* trait is also of use in breeding programmes. The marker or the alleles of the gene responsible for the trait can be used to separate the *virescens*, and *nigrescens* plants in the nursery (e.g., at the seed or seedling stage); the advantage here being that they could be planted separately based on fruit color phenotype, and cross-pollination can be reduced or eliminated. Finally, due to the dominant negative nature of at least some of the *virescens* alleles described herein, homozygous *virescens* lines can provide *virescens* palms even if crossed to a *nigrescens* line, whether accidentally or deliberately.

Any marker that exists that is polymorphic between the parent *nigrescens* and *virescens* plant in a cross and is linked to the VIR locus has the potential to serve as a molecular signal to identify *virescens* plants in a cross. For example, if a *virescens* plant, which is homozygous for mutant and dominant "VIR" (i.e., V/V) at a given SNP position near the fruit color locus is crossed with a *nigrescens* plant that is homozygous for wildtype and recessive "vir" (i.e., v/v) at the same SNP position, then one could genotype seeds of the cross, or one could genotype plantlets arising from seeds of the cross, at the SNP position to track and identify contaminant seeds or plantlets. Seeds that are determined to be heterozygous at the SNP position, (i.e., V/v) or homozygous "V" at the SNP position (i.e., V/V) are very likely to be *virescens*, unless (an unlikely) recombination between the marker and the VR gene had occurred in the individual being genotyped. Similarly, seeds which are homozygous at the SNP position for "v", (i.e., v/v), are *nigrescens* contaminant plants and likely to produce fruit that does not change color significantly upon ripening. Markers that are in closer proximity to the VIR locus would have higher predictive accuracy than markers that are farther away from the locus, because the closer the marker is to the VIR gene, the less likely a recombination could occur which would break the linkage between the marker and the VIR gene. Consequently, polymorphic markers within the VIR gene itself are expected to have the strongest predictive power, and analysis of multiple markers closely linked to or within the VIR gene may be advantageous.

II. Determination of Fruit Color Phenotype

In view of the discovery that the VIR genotype segregates with the *virescens/nigrescens* fruit color phenotype, genotyping a plant or seed at the VIR locus or at adjacent genomic regions can be used to predict the fruit color phenotype of a palm plant.

SEQ ID NO:4 represents the predicted amino acid sequence of the protein expressed in oil palm of the *nigrescens* fruit type. In oil palm of the *nigrescens* fruit type, the proteins derived from *nigrescens* alleles of the VIR gene include multiple Myb-type transcription factor DNA binding domains as well as additional C-terminal amino acids.

SEQ ID NOs: 5, 8, 10, 12, and 14 represent the predicted amino acid sequence of proteins encoded by naturally occurring dominant negative alleles in oil palm of the *virescens* fruit type. In some embodiments, endogenous *virescens* protein is a truncation of SEQ ID NO: 4 caused by a premature stop codon. In some cases, the premature stop codon results from a frame shift mutation. In some cases, the premature stop codon results from a rearrangement within the gene. In still other cases, the premature stop codon results from a mutation in one, two, three or more nucleotides within the VIR gene. In other embodiments, the endogenous *virescens* protein is not truncated relative to SEQ ID NO: 4, yet is still dominant negative due to, e.g., a point mutation, insertion, deletion, or other alteration. In some cases, the dominant negative mutation is in exon3 of VIR. In some cases, the endogenous *virescens* allele is recessive. In such cases, the *virescens* phenotype is identified or detected in plants that are homozygous for the recessive *virescens* mutation. A recessive *virescens* mutation can include, for example, a premature stop codon that does not leave a functionally intact DNA binding domain. Alternatively, a recessive *virescens* mutation can contain a mutation that reduces transcription or translation of VIR, or reduces the stability of VIR.

Oil palm plants of the *nigrescens* fruit type can result from at least two possibilities: i) both alleles coding for the SEQ ID NO:4 protein sequence, or ii) one allele coding for a SEQ ID NO:4 protein sequence, and one allele coding for a different sequence that is not dominant negative over the SEQ ID NO:4 allele.

Oil palm plants of the *virescens* fruit type are the result of one of several possibilities, including, but not limited to: i) two VIR alleles, each of which encode for a dominant negative VIR protein such as a VIR protein containing an amino acid sequence selected from the group consisting of SEQ ID NO:5, SEQ 11D NO:8, SEQ ID NO:10, SEQ ID NO:12, and SEQ ID NO:14; ii) one allele coding for a dominant negative VIR protein, such as a VIR protein containing an amino acid sequence selected from the group consisting of SEQ ID NO:5, SEQ ID NO:8, SEQ ID NO:10, SEQ ID NO:12, and SEQ ID NO:14, and one allele coding for SEQ ID NO; 4 or a recessive mutation in SEQ ID NO: 4; or iii) two alleles coding for a recessive mutation in SEQ ID NO:4.

It will be appreciated that SEQ ID NOS:4, 5, 8, 10, 12, and 14 are representative sequences and that different individual palms may have VIR alleles encoding an amino acid sequence having one or more amino acid changes relative to SEQ ID NOS: 4, 5, 8, 10, 12, and 14 due, for example, to natural variation. It will also be appreciated that SEQ ID NOS: 5, 8, 10, 12, and 14, are representative dominant negative mutations and other possible dominant negative mutations are contemplated. For example, mutations that leave the DNA binding domain functionally intact but inactivate one or more interaction or activation domains can be dominant negative. In some cases, mutations in exon 3 of the VIR gene (FIG. 5*a*, bolded), including but not limited to those that introduce premature stop codons in exon 3 of the VIR gene, can be dominant negative.

In some embodiments, mutations upstream and/or downstream of SEQ ID NO:2, including mutations within SEQ ID NO:1 or mutations upstream and/or downstream of SEQ ID NO:1 can give rise to dominant negative or recessive negative VIR alleles. For example, mutations upstream and/or downstream of SEQ ID NO:2 can reduce transcription or translation of VIR. In such cases, *virescens* plants contain two copies of such recessive negative VIR alleles, or one copy of a recessive allele and one copy of a dominant negative allele.

One or more polymorphism(s) between *nigrescens* and *virescens* VIR alleles can be used to predict the fruit color phenotype of a palm or other plant, e.g., before the plant is at a developmental stage to produce fruit. For example, when the *virescens* polymorphism is dominant negative (e.g., a diploid plant with one functional and one non-functional allele has the same phenotype as a plant with two non-functional alleles) then:

the presence of only a *virescens* VIR allele indicates that the plant has or will have a *virescens* fruit color phenotype;

the presence of only a *nigrescens* VIR allele indicates that the plant has or will have a *nigrescens* fruit color phenotype; and the presence of a *nigrescens* VIR allele and a *virescens* VIR allele indicates that the plant has or will have a *virescens* fruit color phenotype.

SEQ ID NOS:6, 7, 9, 11, 13, and 15 represent coding sequences of various naturally occurring dominant negative *virescens* alleles identified.

Genomic regions adjacent to the VIR gene are also useful to determining whether a palm plant will likely manifest a particular fruit color phenotype. Because of genetic linkage to the VIR gene, polymorphisms adjacent to the VIR locus are predictive of fruit color phenotype, albeit with reduced accuracy as a function of increased distance from the VIR locus. SEQ ID NO:17 provides an approximately 2 MB genomic region of the palm genome that comprises the VIR gene. Single nucleotide polymorphisms within this region can be useful predictors of fruit color phenotype. Table 3 provides a listing of some SNPs identified within SEQ ID NO:17. A small selection of the SNPs in Table 3 have been genetically mapped relative to the VIR locus. Table 3 also provides an estimated predictive value for each SNP provided based on the selection of markers mapped.

For example, SNPM02708 and SNPM02400 represent SNPs that are accurate in predicting fruit color phenotype more than 90% of the time. Said another way, using SNPM02708 or SNPM02400 as a genetic marker, one can correctly predict fruit color phenotype of palm plants more than 90 out of 100 times. Thus, even outside of the VIR locus on the palm chromosome, polymorphic markers allow for relatively accurate prediction of fruit color phenotype of plants. In some embodiments, the polymorphic marker is within 1, 10, 20, 50, 100, 200, 500, 1000, 1500, 2000, 2500, 3000, 3500, 400, 4500, or 5000 kb of the VIR gene (e.g., the gene corresponding to SEQ ID NO:1).

Accordingly, methods of detecting one or more polymorphic markers within a region of the palm genome corresponding to SEQ ID) NO:17, or within a region corresponding to SEQ ID NO: 1 are provided. Such methods are useful for predicting fruit color phenotype of palm plants for example. While specific polymorphisms are provided, it should be appreciated that the polymorphisms provided are merely an example of polymorphisms within the genomic region corresponding to SEQ ID NO:17 or SEQ ID NO:1. Additional polymorphisms can be identified as desired and also be used to predict fruit color phenotype of a palm plant. Such additional polymorphisms are intended to be encompassed in the methods described herein. Moreover, it will be appreciated that SEQ ID NO:17 and SEQ ID NO:1 are representative sequences and that different individual palms may have a corresponding genomic region having one or more nucleotide changes relative to SEQ ID NO:17 or SEQ ID NO:1 due, for example, to natural variation. As noted elsewhere herein, nevertheless, identifying the region of a genome corresponding to SEQ ID NO:17 and SEQ ID NO:1 can be readily performed using alignment programs, sequence similarity searches, etc. . . . . .

The nucleic acid sequences provided herein were generated by nucleotide sequencing and on occasion, include one or more stretches of "N's." These stretches of N's represent gaps in assembly of sequences of an estimated size. The precise number of N's in a sequence is an estimate (for example, 100 N's may only represent 30 bases). N's can be any base, and are likely repetitive sequence in the genome.

In some embodiments, fruit color phenotype can be predicted and shell thickness phenotype (e.g., *dura, pisifera*, and *tenera*) can be predicted. In some cases, the fruit color and shell thickness phenotypes can be predicted at the same time, e.g., as part of a single-pass sampling, identification, and/or sorting method. In some cases, the fruit color and shell thickness phenotypes can be predicted using the same nucleic acid sample. For example, a nucleic acid sample can be extracted from a portion of a plant or a seed and teated for the presence or absence of a *viriscens* allele or a polymorphism in linkage disequilibrium with a *virescens* or *nigrescens* allele and tested to predict the shell thickness phenotype of the plant or seed. Methods for predicting SHELL thickness include, but are not limited to, determining the genotype at the SHELL locus, determining the genotype of a polymorphism in linkage disequilibrium with the SHELL locus, determining the genotype of a gene that controls the shell thickness phenotype (e.g., a gene encoding a MADS box protein), or identifying the presence or absence of a polymorphism in linkage disequilibrium with a gene that controls the shell thickness phenotype. Methods, compositions and kits for predicting shell thickness are described, e.g., in PCT Publication No. 2013/142187; U.S. Patent Application No. 61/612,885, filed on Mar. 19, 2012; U.S. Patent Application No. 61/847,853 filed on Jul. 18, 2013; and U.S. Application No. 61/856,433, filed on Jul. 19, 2013, the contents of which are hereby incorporated by reference in their entirety for all purposes.

A. Detection

Described herein are methods for predicting the fruit color phenotype an oil palm plant. Exemplary methods include, but are not limited to contacting oil palm plant nucleic acid containing the VIR gene with an endonuclease (e.g., AseI, or an isoschizomer thereof) that cuts the *nigrescens* VIR allele sequence (SEQ ID NO:1) or a portion thereof, but does not cut the dominant *virescens* allele SEQ ID NO:9 (VIR mutation event 2) or a corresponding portion thereof. Exemplary methods further include, but are not limited to contacting oil palm plant nucleic acid containing the VIR gene with an endonuclease (e.g., AluI, or an isoschizomer thereof) that cleaves the dominant *virescens* allele SEQ ID NO:11 (VIR mutation event 3) or a portion thereof, but does not cleave the *nigrescens* VIR allele SEQ ID NO:1 or a corresponding portion thereof. Exemplary methods further include, but are not limited to contacting oil palm plant nucleic acid containing the VIR gene with an endonuclease (e.g., AseI, or an isoschizomer thereof) that cleaves the dominant *virescens* allele SEQ ID NO:15 (VIR mutation event 5) or a portion thereof, but does not cleave the *nigrescens* VIR allele SEQ ID NO:1 or a corresponding portion thereof. In some cases, the portion thereof in the wild-type sequence or the corresponding portion thereof in the non wild-type sequence is provided as an amplified product (amplicon) or obtained by contacting genomic wild-type or mutated nucleic acid with flanking primers and amplifying.

Exemplary methods also include contacting a portion of oil palm plant nucleic acid with a first endonuclease (e.g., AseI) and a portion of oil palm plant nucleic acid with a second endonuclease (e.g., AluI). In some cases, a portion of the oil palm plant nucleic acid is contacted with additional endonucleases (e.g., contacted with 1, 2, 3, 4, 5, 6, 7, 8, 9, 10, 11, or 12 additional endonucleases). The resulting cleavage patterns can be analyzed to determine the presence or absence of one or more VIR genotypes and thus predict the fruit color phenotype. In some cases, each endonuclease is contacted with oil palm nucleic acid in a separate reaction mixture. In other cases, two or more endonucleases (e.g., 2, 3, 4, 5, 6, 7, 8, 9, 10, 11, or 12 or more endonucleases) are contacted with oil palm nucleic acid in a single reaction mixture. The oil palm plant nucleic acid can be amplified before contact with endonuclease and/or amplified after contact with endonuclease.

More generally, methods for predicting the fruit color phenotype of an oil palm plant include contacting nucleic acid containing the VIR gene with a protein or oligonucleotide that recognizes the VIR gene or a sequence linked to the VIR gene and then detecting recognition (e.g., binding or cleavage). The detection reagent (e.g., protein or oligonucleotide) can be specific for one or more naturally occurring VIR alleles (e.g., SEQ ID NOS:1, 2, 3, 7, 9, 11, 13, or 15). In some cases, the method includes amplifying a VIR gene sequence or a sequence linked to the VIR gene, or a portion of the gene or linked sequence, and detecting the amplification. In some embodiments, the method includes a combination of contacting with a detection reagent and amplification. For example, nucleic acid containing, or linked to, the VIR gene, or a portion thereof, can be amplified, and an oligonucleotide or protein detection reagent (e.g., a restriction enzyme such as Ase I, or Alu I, or an isoschizomer thereof) can be contacted with the amplified nucleic acid. In some cases, further amplification can then be performed. Alternatively, the protein detection reagent can be contacted with nucleic acid containing or linked to the VIR gene, or a portion thereof, then amplified. In some embodiments, alleles, or portions thereof, that are recognized by the detection reagent (e.g., protein or oligonucleotide) are amplified, whereas alleles or portions thereof that are not recognized (e.g., not bound to or cleaved) are not amplified. In other embodiments, alleles that are not recognized by the detection reagent, or portions thereof, are amplified and recognized by the detection agent (e.g., bound to or cleaved) alleles, or portions thereof, are not amplified.

In some embodiments, the methods include amplifying oil palm plant nucleic acid and contacting the amplified nucleic acid with a detection reagent (e.g., an oligonucleotide or a protein). The presence or activity of the detection reagent (e.g., binding or cleavage) can then be assayed as described herein. Alternatively, the nucleic acid can be contacted with the detection reagent, and then amplification can be performed. In some cases, VIR alleles that are not recognized by the detection reagent can be amplified while VIR alleles that are recognized by the detection reagent are not substantially amplified or are not amplified. In some cases, VIR alleles that are recognized by the detection reagent can be amplified while VIR alleles that are not recognized by the detection reagent are not substantially amplified or are not amplified.

1. Endonuclease Detection

In some embodiments, contacting the oil palm nucleic acid (or an amplified portion thereof comprising at least a portion of the VIR gene, or a sequence linked to the VIR gene) with a detection reagent includes contacting the oil palm nucleic acid with an endonuclease that specifically recognizes one or more VIR alleles under conditions that allow for sequence specific cleavage of the one or more recognized alleles. Such conditions will be dependent on the endonuclease employed, but generally include an aqueous buffer, salt (e.g., NaCl), and a divalent cation (e.g., $Mg^2$, $Ca^{2+}$, etc.). The cleavage can be performed at any temperature at which the endonuclease is active, e.g., at least about 5, 7.5, 10, 15, 20, 25, 30, 35, 37, 40, 42, 45, 50, 55, or 65° C. The cleavage can be performed for any length of time such as about 1, 2, 3, 4, 5, 6, 7, 8, 9, 10, 12, 15, 17, 20, 25, 30, 35, 40, 45, 50, 60, 70, 90, 100, 120 minutes; about 2, 3, 4, 5, 6, 7, 8, 10, 12, 14, 16, 18, 20 hours, or about 1, 2, 3, or 4 days. In some cases, the oil palm nucleic acid, or a portion thereof (e.g., the VIR locus, a portion thereof, or sequence linked to the VIR locus) is amplified and then contacted with an endonuclease. Alternatively, the oil palm nucleic acid, or a portion thereof (e.g., the VIR locus, a portion thereof, or sequence linked to the VIR locus) is contacted with an endonuclease and then amplified.

In some cases, cleavage of the nucleic acid prevents substantial amplification; therefore, lack of amplification indicates successful cleavage and thus presence of the allele or alleles recognized by the endonuclease detection reagent. For example, in some cases, amplification can require a primer pair and cleavage can disrupt the sequence of template nucleotides between the primer pair. Thus, in this case, a cleaved sequence will not be amplified, while the uncleaved sequence will be amplified. As another example, cleavage can disrupt a primer binding site thus preventing amplification of the cleaved sequence and allowing amplification of the uncleaved sequence.

Cleavage can be complete (e.g., all, substantially all or greater than 50% of the VIR locus is cleaved or cleavable) or partial (e.g., less than 50% of the VIR locus is cleaved or cleavable). In some cases, complete cleavage can indicate the presence of a recognized VIR allele and the absence of VIR alleles that are not recognized. For example, complete cleavage can indicate that the plant is homozygous for an allele that is recognized by the detection reagent. Similarly, partial cleavage can indicate the presence of both a recognized VIR allele and a VIR allele that is not recognized. For example, partial cleavage can indicate heterozygosity at the VIR locus or heterozygosity at a genomic position linked to the VIR locus.

In some embodiments, two or more endonucleases with differing specificities for one or more VIR alleles are contacted with oil palm nucleic acid. In some cases, the oil palm nucleic acid is, optionally amplified, divided into separate reactions, optionally amplified, and each of the two or more endonucleases added to a separate reaction. One or more control reactions that include, e.g., no endonuclease, no nucleic acid, no amplification, or control nucleic acid can also be included.

After contact with an endonuclease that recognizes one or more alleles but does not recognize one or more other alleles, cleavage can then be detected. Detection of complete cleavage indicates the presence of the allele(s) recognized by the endonuclease. Detection of partial cleavage in the reaction indicates that the nucleic acid is heterozygous for a recognized allele and an allele that is not recognized. Detection of no cleavage in the reaction indicates the absence of the one or more alleles recognized by the endonuclease. Thus, the genotypes and their corresponding fruit color phenotypes (*nigrescens* and *virescens* respectively) can be predicted based on comparing the cleavage pattern of the one or more endonuclease reactions.

Cleavage can be detected by assaying for a change in the relative sizes of oil palm nucleic acid or a portion thereof (e.g., the VIR locus, a portion thereof, or a sequence linked to the VIR locus). For example, oil palm nucleic acid or a portion thereof (e.g., the VIR locus, a portion thereof, or a sequence linked to the VIR locus) can be contacted with one or more endonucleases in a reaction mixture, optionally amplified, the reaction mixture loaded onto an agarose or acrylamide gel, electrophoresed, and the relative sizes of the nucleic acids visualized or otherwise detected. The electrophoresis can be slab gel electrophoresis or capillary electrophoresis. Cleavage can also be detected by assaying for successful amplification of the oil palm nucleic acid or a portion thereof (e.g., the VIR locus, a portion thereof, or a sequence linked to the VIR locus). For example, oil palm nucleic acid or a portion thereof (e.g., the VIR locus, a portion thereof, or a sequence linked to the VIR locus) can be contacted with one or more endonucleases in a reaction mixture, amplified, the reaction mixture loaded onto an agarose or acrylamide gel, electrophoresed, and the presence or absence of one or more amplicons, or the relative sizes of amplicons visualized or otherwise detected.

Detection of cleavage products can be quantitative or semi-quantitative. For example, visualization or other detection can include detection of fluorescent dyes intercalated into double stranded DNA. In such cases, the fluorescent signal is proportional to both the size of the fluorescent DNA molecule and the molar quantity. Thus, after correction for the size of the DNA molecule, the relative molar quantities of cleavage products can be compared. In some cases, quantitative detection provides discrimination between partial and complete cleavage or discrimination between a plant that is homozygous at the VIR locus or heterozygous at the VIR locus.

2. Oligonucleotide Detection

In other embodiments, contacting the oil palm nucleic acid with a detection reagent includes contacting the oil palm nucleic acid or a portion thereof (e.g., the VIR locus, a portion thereof, or a sequence linked to the VIR locus) with an oligonucleotide specific for one or more VIR alleles under conditions which allow for specific hybridization to one or more of the one or more VIR alleles or specific cleavage of one or more of the one or more VIR alleles. Such conditions can include stringent conditions as described herein. Such conditions can also include conditions that allow specific priming of polymerization by the hybridized oligonucleotide at the VIR locus or at a sequence linked to the VIR locus. Detection of hybridization, cleavage, or polymerization can then indicate the presence of the one or more VIR alleles that the oligonucleotide is specific for. Hybridization can be detected by assaying for the presence of the oligonucleotide, the presence of a label linked to the oligonucleotide, or assaying for polymerization of the oligonucleotide. Polymerization of the oligonucleotide can be detected by assaying for amplification as described herein. Polymerization of the oligonucleotide can also be detected by assaying for the incorporation of a detectable label during the polymerization process.

In some embodiments, one or more VIR allies can be detected by annealing one or more primers to template nucleic acid, extending the one or more primers, and then detecting incorporation of one or more nucleotides. For example, a primer extension assay can be performed. Primer extension is a two-step process that first involves the hybridization of a probe to the bases immediately upstream of a nucleotide polymorphism, such as the polymorphisms that give rise to the *nigrescens* or *virescens* phenotypes, followed by a mini-sequencing reaction, in which DNA polymerase extends the hybridized primer by adding one or more bases that are complementary to one or more of the polymorphic sequences. At each position, incorporated bases are detected and the identity of the allele is determined. Because primer extension is based on the highly accurate DNA polymerase enzyme, the method is generally very reliable. Primer extension is able to genotype most polymorphisms under very similar reaction conditions making it also highly flexible. The primer extension method is used in a number of assay formats. These formats use a wide range of detection techniques that include fluorescence, chemiluminescence, directly sensing the ions produced by template-directed DNA polymerase synthesis, MALDI-TOF Mass spectrometry and ELISA-like methods.

Primer extension reactions can, e.g., be performed with either fluorescently labeled dideoxynucleotides (ddNTP) or fluorescently labeled deoxynucleotides (dNTP). With ddNTPs, probes hybridize to the target DNA immediately upstream of polymorphism, and a single, ddNTP complementary to at least one of alleles is added to the 3' end of the probe (the missing 3'-hydroxyl in didioxynucleotide prevents further nucleotides from being added). Each ddNTP is labeled with a different fluorescent signal allowing for the detection of all four possible single nucleotide variations in the same reaction. The reaction can be performed in a multiplex reaction (for simultaneous detection of multiple polymorphisms) by using primers of different lengths and detecting fluorescent signal and length. With dNTPs, allele-specific probes have 3' bases which are complementary to each of the possible nucleotides to be detected. If the target DNA contains a nucleotide complementary to the probe's 3' base, the target DNA will completely hybridize to the probe, allowing DNA polymerase to extend from the 3' end of the probe. This is detected by the incorporation of the fluorescently labeled dNTPs onto the end of the probe. If the target DNA does not contain a nucleotide complementary to the probe's 3' base, the target DNA will produce a mismatch at the 3' end of the probe and DNA polymerase will not be able to extend from the 3' end of the probe. In this case, several labeled dNTPs may get incorporated into the growing strand, allowing for increased signal. Exemplary primer extension methods and compositions include the SNaPshot method. Primer extension reactions can also be performed using a mass spectrometer. The extension reaction can use ddNTPs as above, but the detection of the allele is dependent on the actual mass of the extension product and not on a fluorescent molecule.

In some cases, two or more oligonucleotides with differing specificities for one or more VIR alleles are contacted with oil palm nucleic acid or a portion thereof (e.g., the VIR locus, a portion thereof, or a sequence linked to the VIR locus). In some cases, the two or more oligonucleotides are differentially labeled. In such cases, the contacting can be performed in a single reaction, and hybridization can be differentially detected. Alternatively, the two or more oligonucleotides can be contacted with oil palm nucleic acid that has been separated into two or more reactions, such that each reaction can be contacted with a different oligonucleotide. As yet another alternative, the two or more oligonucleotides can be hybridized to oil palm nucleic in a single reaction, polymerization or amplification performed at the VIR locus, or a sequence linked to the VIR locus, and amplification or polymerization of the template nucleic acid can be differentially detected. For example, one or more of the oligonucleotides can be blocking oligonucleotides such that amplification does not substantially occur when the oligonucleotide is bound. As another example, the two or more oligonucleotides can contain a fluorophore and a quencher, such that amplification of the specifically bound oligonucleotide degrades the oligonucleotide and provides an increase in fluorescent signal. As yet another example, polymerization or amplification can provide polymerization/amplification products of a size that is allele specific. In some cases, one or more control reactions are also included, such as a no-oligonucleotide control, or a positive control containing one or more VIR allele nucleic acid(s).

For example, an oligonucleotide specific for the a *nigrescens* VIR allele, and an oligonucleotide specific for a *virescens* allele can be contacted with oil palm nucleic acid under stringent conditions. Unbound oligonucleotide and/or nucleic acid can then be washed away. Hybridization can then be detected. Hybridization of only the first oligonucleotide would indicate the presence of the *nigrescens* allele, and thus predict a *nigrescens* phenotype. Hybridization of one or more oligonucleotides specific for a dominant *virescens* VIR allele would predict a *virescens* phenotype. Hybridization of an oligonucleotide specific for a recessive *virescens* VIR allele and an oligonucleotide specific for the *nigrescens* VIR allele would predict a *nigrescens* phenotype. Hybridization of an oligonucleotide specific for a recessive *virescens* VIR allele but not an oligonucleotide specific for the *nigrescens* VIR allele would predict a *virescens* phenotype.

As another example, oil palm nucleic acid can be contacted with three oligonucleotides in three different reaction mixtures. The first oligonucleotide can be capable of specifically hybridizing to the wild-type or *nigrescens* allele (e.g., SEQ ID NO:1). The second oligonucleotide can be capable of specifically hybridizing to a dominant *virescens* allele. The third oligonucleotide can be capable of specifically hybridizing to a different dominant *virescens* allele. Additional allele specific oligonucleotides can optionally be utilized. The reaction mixtures can optionally contain another oligonucleotide that specifically hybridizes to the a sequence in the oil palm genome and in combination with any of the first, second, third or more oligonucleotide primers flanks a region, e.g., about 10, 25, 50, 100, 150, 200, 250, 300, 350, 500, 600, 750, 1000, 2000, 5000, 7500, 10000 or more continuous nucleotides, of the oil palm genome at or near the VIR locus. The allele specific oligonucleotides can then be polymerized and the presence or absence of polymerization product detected. For example, PCR can be performed. In some cases, the presence or absence of polymerization product is detected by detection of amplification. In some cases, the presence or absence of polymerization product is detected by detection of a label incorporated during the polymerization.

Differential detection of a polymerization product of each allele specific oligonucleotide would indicate the presence of the corresponding VIR allele. Thus, VIR genotypes can be detected and the resulting phenotypes predicted. In some cases, the polymerization and/or detection can be quantitative or semi-quantitative such that homozygous and heterozygous plants can be distinguished.

As some allele-specific differences in the VIR gene are SNPs, methods useful for SNP detection can also be used to detect the VIR alleles. The amount and/or presence of an allele of a SNP in a sample from an individual can be determined using many detection methods that are well known in the art. A number of SNP assay formats entail one of several general protocols: hybridization using allele-specific oligonucleotides, primer extension, allele-specific ligation, sequencing, or electrophoretic separation techniques, e.g., singled-stranded conformational polymorphism (SSCP) and heteroduplex analysis. Exemplary assays include 5' nuclease assays, template-directed dye-terminator incorporation, molecular beacon allele-specific oligonucleotide assays, single-base extension assays, and SNP scoring by real-time pyrophosphate sequences. Analysis of amplified sequences can be performed using various technologies such as microchips, fluorescence polarization assays, and matrix-assisted laser desorption ionization (MALDI) mass spectrometry. Two methods that can also be used are assays based on invasive cleavage with Flap nucleases and methodologies employing padlock probes.

Determining the presence or absence of a particular SNP allele is generally performed by analyzing a nucleic acid sample that is obtained from a biological sample from the individual to be analyzed. While the amount and/or presence of a SNP allele can be directly measured using RNA from the sample, often times the RNA in a sample will be reverse transcribed, optionally amplified, and then the SNP allele will be detected in the resulting cDNA.

Frequently used methodologies for analysis of nucleic acid samples to measure the amount and/or presence of an allele of a SNP are briefly described. However, any method known in the art can be used in the invention to measure the amount and/or presence of single nucleotide polymorphisms.

3. Allele Specific Hybridization

This technique, also commonly referred to as allele specific oligonucleotide hybridization (ASO) (e.g., Stoneking et al., *Am. J. Hum. Genet.* 48:70-382, 1991; Saiki et al., *Nature* 324, 163-166, 1986; EP 235,726; and WO 89/11548), relies on distinguishing between two DNA molecules differing by one base by hybridizing an oligonucleotide probe that is specific for one of the variants to an amplified product obtained from amplifying the nucleic acid sample. In some embodiments, this method employs short oligonucleotides, e.g., 15-20 bases in length. The probes are designed to differentially hybridize to one variant versus another. Principles and guidance for designing such probe is available in the art, e.g., in the references cited herein. Hybridization conditions should be sufficiently stringent that there is a significant difference in hybridization intensity between alleles, and preferably an essentially binary response, whereby a probe hybridizes to only one of the alleles. Some probes are designed to hybridize to a segment of target DNA or cDNA such that the polymorphic site aligns with a central position (e.g., within 4 bases of the center of the oligonucleotide, for example, in a 15-base oligonucleotide at the 7 position; in a 16-based oligonucleotide at either the 8 or 9 position) of the probe (e.g., a polynucleotide of the invention distinguishes between two SNP alleles as set forth herein), but this design is not required.

The amount and/or presence of an allele is determined by measuring the amount of allele-specific oligonucleotide that is hybridized to the sample. Typically, the oligonucleotide is labeled with a label such as a fluorescent label. For example, an allele-specific oligonucleotide is applied to immobilized oligonucleotides representing potential SNP sequences. After stringent hybridization and washing conditions, fluorescence intensity is measured for each SNP oligonucleotide.

In one embodiment, the nucleotide present at the polymorphic site is identified by hybridization under sequence-specific hybridization conditions with an oligonucleotide probe exactly complementary to one of the polymorphic alleles in a region encompassing the polymorphic site. The probe hybridizing sequence and sequence-specific hybridization conditions are selected such that a single mismatch at the polymorphic site destabilizes the hybridization duplex sufficiently so that it is effectively not formed. Thus, under sequence-specific hybridization conditions, stable duplexes will form only between the probe and the exactly complementary allelic sequence. Thus, oligonucleotides from about 10 to about 35 nucleotides in length, e.g., from about 15 to about 35 nucleotides in length, which are exactly complementary to an allele sequence in a region which encompasses the polymorphic site (e.g., the polymorphisms outlined in SEQ ID NOS:7, 9, 11, 13, 15, 21, 22, 23, or 24) are within the scope of the invention.

In an alternative embodiment, the amount and/or presence of the nucleotide at the polymorphic site is identified by hybridization under sufficiently stringent hybridization conditions with an oligonucleotide substantially complementary to one of the SNP alleles in a region encompassing the polymorphic site, and exactly complementary to the allele at the polymorphic site. Because mismatches that occur at non-polymorphic sites are mismatches with both allele sequences, the difference in the number of mismatches in a duplex formed with the target allele sequence and in a duplex formed with the corresponding non-target allele sequence is the same as when an oligonucleotide exactly complementary to the target allele sequence is used. In this embodiment, the hybridization conditions are relaxed sufficiently to allow the formation of stable duplexes with the target sequence, while maintaining sufficient stringency to preclude the formation of stable duplexes with non-target sequences. Under such sufficiently stringent hybridization conditions, stable duplexes will form only between the probe and the target allele. Thus, oligonucleotides from about 10 to about 35 nucleotides in length, preferably from about 15 to about 35 nucleotides in length, which are substantially complementary to an allele sequence in a region which encompasses the polymorphic site, and are exactly complementary to the allele sequence at the polymorphic site, are within the scope of the invention.

The use of substantially, rather than exactly, complementary oligonucleotides may be desirable in assay formats in which optimization of hybridization conditions is limited. For example, in a typical multi-target immobilized-probe assay format, probes for each target are immobilized on a single solid support. Hybridizations are carried out simultaneously by contacting the solid support with a solution containing target DNA or cDNA. As all hybridizations are carried out under identical conditions, the hybridization conditions cannot be separately optimized for each probe. The incorporation of mismatches into a probe can be used to adjust duplex stability when the assay format precludes adjusting the hybridization conditions. The effect of a particular introduced mismatch on duplex stability is well known, and the duplex stability can be routinely both estimated and empirically determined, as described above. Suitable hybridization conditions, which depend on the exact size and sequence of the probe, can be selected empirically using the guidance provided herein and well known in the art. The use of oligonucleotide probes to detect single base pair differences in sequence is described in, for example, Conner et al., 1983, *Proc. Natl. Acad. Sci. USA* 80:278-282, and U.S. Pat. Nos. 5,468,613 and 5,604,099, each incorporated herein by reference.

The proportional change in stability between a perfectly matched and a single-base mismatched hybridization duplex depends on the length of the hybridized oligonucleotides. Duplexes formed with shorter probe sequences are destabilized proportionally more by the presence of a mismatch. In practice, oligonucleotides between about 15 and about 35 nucleotides in length are preferred for sequence-specific detection. Furthermore, because the ends of a hybridized oligonucleotide undergo continuous random dissociation and re-annealing due to thermal energy, a mismatch at either end destabilizes the hybridization duplex less than a mismatch occurring internally. Preferably, for discrimination of a single base pair change in target sequence, the probe sequence is selected which hybridizes to the target sequence such that the polymorphic site occurs in the interior region of the probe.

The above criteria for selecting a probe sequence that hybridizes to a particular SNP apply to the hybridizing region of the probe, i.e., that part of the probe which is involved in hybridization with the target sequence. A probe may be bound to an additional nucleic acid sequence, such as a poly-T tail used to immobilize the probe, without significantly altering the hybridization characteristics of the probe. One of skill in the art will recognize that for use in the present methods, a probe bound to an additional nucleic acid sequence which is not complementary to the target sequence and, thus, is not involved in the hybridization, is essentially equivalent to the unbound probe.

Suitable assay formats for detecting hybrids formed between probes and target nucleic acid sequences in a sample are known in the art and include the immobilized target (dot-blot) format and immobilized probe (reverse dot-blot or line-blot) assay formats. Dot blot and reverse dot blot assay formats are described in U.S. Pat. Nos. 5,310,893; 5,451,512; 5,468,613; and 5,604,099; each incorporated herein by reference.

In a dot-blot format, amplified target DNA or cDNA is immobilized on a solid support, such as a nylon membrane. The membrane-target complex is incubated with labeled probe under suitable hybridization conditions, unhybridized probe is removed by washing under suitably stringent conditions, and the membrane is monitored for the presence of bound probe.

In the reverse dot-blot (or line-blot) format, the probes are immobilized on a solid support, such as a nylon membrane or a microtiter plate. The target DNA or cDNA is labeled, typically during amplification by the incorporation of labeled primers. One or both of the primers can be labeled. The membrane-probe complex is incubated with the labeled amplified target DNA or cDNA under suitable hybridization conditions, unhybridized target DNA or cDNA is removed by washing under suitably stringent conditions, and the membrane is monitored for the presence of bound target DNA or cDNA.

An allele-specific probe that is specific for one of the polymorphism variants is often used in conjunction with the allele-specific probe for the other polymorphism variant. In some embodiments, the probes are immobilized on a solid support and the target sequence in an individual is analyzed using both probes simultaneously. Examples of nucleic acid arrays are described by WO 95/11995. The same array or a different array can be used for analysis of characterized polymorphisms. WO 95/11995 also describes sub-arrays that are optimized for detection of variant forms of a pre-characterized polymorphism.

In some embodiments, allele-specific oligonucleotide probes can be utilized in a branched DNA assay to differentially detect VIR alleles. For example, allele-specific oligonucleotide probes can be used as capture extender probes that hybridize to a capture probe and VIR in an allele specific manner. Label extenders can then be utilized to hybridize to VIR in a non allele-specific manner and to an amplifier (e.g., alkaline phosphatase). In some cases, a pre-amplifier molecule can further increase signal by binding to the label extender and a plurality of amplifiers. As another example, non allele-specific capture extender probes can be used to capture VIR, and allele-specific label extenders can be used to differentially detect VIR alleles. In some cases, the capture extender probes and/or label extenders hybridize to allele specific VIR cleavage sites (e.g., hybridize to an AseI, or AluI site). In some cases, the probes do not hybridize to VIR DNA that has been cleaved with an allele specific endonuclease (e.g., AseI, or AluI, or an isoschizomer thereof).

4. Allele-Specific Primers

The amount and/or presence of an allele is also commonly detected using allele-specific amplification or primer extension methods. These reactions typically involve use of primers that are designed to specifically target a polymorphism via a mismatch at the 3' end of a primer. The presence of a mismatch affects the ability of a polymerase to extend a primer when the polymerase lacks error-correcting activity. For example, to detect an allele sequence using an allele-specific amplification- or extension-based method, a primer complementary to the polymorphic nucleotide of a SNP is designed such that the 3' terminal nucleotide hybridizes at the polymorphic position. The presence of the particular allele can be determined by the ability of the primer to initiate extension. If the 3' terminus is mismatched, the extension is impeded. If a primer matches the polymorphic nucleotide at the 3' end, the primer will be efficiently extended.

The primer can be used in conjunction with a second primer in an amplification reaction. The second primer hybridizes at a site unrelated to the polymorphic position.

Amplification proceeds from the two primers leading to a detectable product signifying the particular allelic form is present. Allele-specific amplification- or extension-based methods are described in, for example, WO 93/22456; U.S. Pat. Nos. 5,137,806; 5,595,890; 5,639,611; and U.S. Pat. No. 4,851,331.

Using allele-specific amplification-based methods, identification and/or quantification of the alleles require detection of the presence or absence of amplified target sequences. Methods for the detection of amplified target sequences are well known in the art. For example, gel electrophoresis and probe hybridization assays described are often used to detect the presence of nucleic acids.

In an alternative probe-less method, the amplified nucleic acid is detected by monitoring the increase in the total amount of double-stranded DNA in the reaction mixture, is described, e.g., in U.S. Pat. No. 5,994,056; and European Patent Publication Nos. 487,218 and 512,334. The detection of double-stranded target DNA or cDNA relies on the increased fluorescence various DNA-binding dyes, e.g., SYBR Green, exhibit when bound to double-stranded DNA.

Allele-specific amplification methods can be performed in reactions that employ multiple allele-specific primers to target particular alleles. Primers for such multiplex applications are generally labeled with distinguishable labels or are selected such that the amplification products produced from the alleles are distinguishable by size. Thus, for example, both alleles in a single sample can be identified and/or quantified using a single amplification by various methods.

As in the case of allele-specific probes, an allele-specific oligonucleotide primer may be exactly complementary to one of the polymorphic alleles in the hybridizing region or may have some mismatches at positions other than the 3' terminus of the oligonucleotide, which mismatches occur at non-polymorphic sites in both allele sequences.

5. Amplification

Amplification includes any method in which nucleic acid is reproduced, copied, or amplified. In some cases, the amplification produces a copy of the template nucleic acid. In other cases, the amplification produces a copy of a portion of the template nucleic acid (e.g., a copy of the VIR locus, a portion thereof, or a sequence linked to the VIR locus). Amplification methods include the polymerase chain reaction (PCR), the ligase chain reaction (LCR), self-sustained sequence replication (3SR), the transcription based amplification system (TAS), nucleic acid sequence-based amplification (NASBA), strand displacement amplification (SDA), rolling circle amplification (RCA), hyper-branched RCA (HRCA), helicase-dependent DNA amplification (HDA), single primer isothermal amplification, signal-mediated amplification of RNA technology (SMART), loop-mediated isothermal amplification (LAMP), isothermal multiple displacement amplification (IMDA), and circular helicase-dependent amplification (cHDA). The amplification reaction can be isothermal, or can require thermal cycling. Isothermal amplification methods, include but are not limited to, TAS, NASBA, 3SR, SMART, SDA, RCA, LAMP, IMDA, HDA, SPIA, and cHDA. Methods and compositions for isothermal amplification are provided in, e.g., Gill and Ghaemi, *Nucleosides, Nucleotides, and Nucleic Acids,* 27: 224-43 (2008).

Loop-mediated isothermal amplification (LAMP) is described in, e.g., Notomi, et al., *Nucleic Acids Research,* 28(12), e63 i-vii, (2000). The method produces large amounts of amplified DNA in a short period of time. In some cases, successful LAMP amplification can produce pyrophosphate ions in sufficient amount to alter the turbidity, or color of the reaction solution. Thus, amplification can be assayed by observing an increase in turbidity, or a change in the color of the sample. Alternatively, amplified DNA can be observed using any amplification detection method including detecting intercalation of a fluorescent dye and/or gel or capillary electrophoresis.

In some cases, the loop-mediated isothermal amplification (LAMP) is performed with four primers or three or more sets of four primers for amplification of the VIR gene, a portion thereof, or a sequence linked to the VIR gene, including a forward inner primer, a forward outer primer, a backward inner primer, and a backward outer primer. In some cases, one, two, or more additional primers can be used to identify multiple regions or alleles in the same reaction. In some cases, LAMP can be performed with one or more of the following primer sets: a set of wild-type VIR specific primers; a set of primers specific for VIR mutant #1 (e.g., specific for SEQ ID NO:7, or a portion thereof); a set of primers specific for VIR mutant #2 (e.g., specific for SEQ ID NO:9, or a portion thereof); a set of primers specific for VIR mutant #3 (e.g., specific for SEQ ID NO:11, or a portion thereof); a set of primers specific for VIR mutant #4 (e.g., specific for SEQ ID NO:13); and/or a a set of primers specific for VIR mutant #5 (e.g., specific for SEQ ID NO:15, or a portion thereof). In some cases, the oil palm plant DNA is analyzed in two or more separate reaction mixtures. For example, one reaction mixture can be used to amplify wild-type VIR containing oil palm plant nucleic acid, and a second reaction mixture to amplify oil palm plant nucleic acid that contains known dominant VIR mutants (e.g., contains any one of SEQ ID NOS:7, 9, 11, 13, or 15, or a portion thereof).

Amplification detection can include end-point detection or real-time detection. End-point detection can include agarose or acrylamide gel electrophoresis and visualization. For example, amplification can be performed on template nucleic acid that has been contacted with one or more detection reagents (e.g., one or more endonucleases), and then the reaction mixture (or a portion thereof) can be loaded onto an acrylamide or agarose gel, electrophoresed, and the relative sizes of amplicons or the presence or absence of amplicons detected. Alternatively, amplification can be performed, amplicons contacted with one or more detection reagents (e.g., one or more endonucleases), and then the reaction mixture (or a portion thereof) can be loaded onto an acrylamide or agarose gel, electrophoresed, and the relative sizes of amplicons or the presence or absence of amplicons detected. Electrophoresis can include slab gel electrophoresis and capillary electrophoresis.

Real-time detection of amplification can include detection of the incorporation of intercalating dyes into accumulating amplicons, detection of fluorogenic nuclease activity, or detection of structured probes. The use of intercalating dyes utilizes fluorogenic compounds that only bind to double stranded DNA. In this type of approach, amplification product (which in some cases is double stranded) binds dye molecules in solution to form a complex. With the appropriate dyes, it is possible to distinguish between dye molecules remaining free in solution and dye molecules bound to amplification product. For example, certain dyes fluoresce efficiently only when bound to double stranded DNA, such as amplification product. Examples of such dyes include, but are not limited to, SYI3R Green and Pico Green (from Molecular Probes, Inc., Eugene, Oreg.), ethidium bromide, propidium iodide, chromomycin, acridine orange, Hoechst 33258, TOTO-1, YOYO-1, and DAPI (4',6-diamidino-2-phenylindole hydrochloride). Additional discussion regarding the use of intercalation dyes is provided, e.g., by Zhu et al., *Anal. Chem.* 66:1941-1948 (1994).

Fluorogenic nuclease assays are another example of a product quantification method that can be used successfully with the devices and methods described herein. The basis for this method of monitoring the formation of amplification product is to measure PCR product accumulation using a dual-labeled fluorogenic oligonucleotide probe, an approach frequently referred to in the literature as the "TaqMan" method.

The probe used in such assays can be a short (e.g., approximately 20-25 bases in length) polynucleotide that is labeled with two different fluorescent dyes. In some cases, the 5' terminus of the probe can be attached to a reporter dye and the 3' terminus attached to a quenching moiety. In other cases, the dyes can be attached at other locations on the probe. The probe can be designed to have at least substantial sequence complementarity with the probe-binding site on the target nucleic acid. Upstream and downstream PCR primers that bind to regions that flank the probe binding site can also be included in the reaction mixture. When the fluorogenic probe is intact, energy transfer between the fluorophore and quencher moiety occurs and quenches emission from the fluorophore. During the extension phase of PCR, the probe is cleaved, e.g., by the 5' nuclease activity of a nucleic acid polymerase such as Taq polymerase, or by a separately provided nuclease activity that cleaves bound probe, thereby separating the fluorophore and quencher moieties. This results in an increase of reporter emission intensity that can be measured by an appropriate detector. Additional details regarding fluorogenic methods for detecting PCR products are described, for example, in U.S. Pat. No. 5,210,015 to Gelfand, U.S. Pat. No. 5,538,848 to Livak, et al, and U.S. Pat. No. 5,863,736 to Haaland, each of which is incorporated by reference in its entirety, as well as Heid, C. A., et al., *Genome Research,* 6:986-994 (1996); Gibson, U. E. M, et al., *Genome Research* 6:995-1001 (1996); Holland, P. M., et al., *Proc. Natl. Acad. Sci. USA* 4 88:7276-7280, (1991): and Livak, K. J., et al., *PCR Methods and Applications* 357-362 (1995).

Structured probes (e.g., "molecular beacons") provide another method of detecting accumulated amplification product. With molecular beacons, a change in conformation of the probe as it hybridizes to a complementary region of the amplified product results in the formation of a detectable signal. In addition to the target-specific portion, the probe includes additional sections, generally one section at the 5' end and another section at the 3' end, that are complementary to each other. One end section is typically attached to a reporter dye and the other end section is usually attached to a quencher dye. In solution, the two end sections can hybridize with each other to form a stem loop structure. In this conformation, the reporter dye and quencher are in sufficiently close proximity that fluorescence from the reporter dye is effectively quenched by the quencher. Hybridized probe, in contrast, results in a linearized conformation in which the extent of quenching is decreased. Thus, by monitoring emission changes for the reporter dye, it is possible to indirectly monitor the formation of amplification product. Probes of this type and methods of their use is described further, for example, by Piatek, A. S., et al., *Nat. Biotechnol.* 16:359-63 (1998); Tyagi, S, and Kramer, F. R., *Nat. Biotechnol.* 14:303-308 (1996); and Tyagi, S. et al., *Nat. Biotechnol.* 16:49-53 (1998).

Detection of amplicons can be quantitative or semi-quantitative whether performed as a real-time analysis or as an end-point analysis. In general, the detection signal (e.g., fluorescence) is proportional to the molar quantity of the amplicon. Thus, the relative molar quantities of amplicons can be compared. In some cases, quantitative detection provides discrimination between a plant that is homozygous at the VIR locus or heterozygous at the VIR locus.

As described herein, hybridization, cleavage, and amplification methods can be combined. For example, oil palm plant nucleic acid can be hybridized to one or more oligonucleotides, cleaved and then amplified. Alternatively, oil palm plant nucleic acid can be amplified, cleaved, and then amplified again, or the cleavage products detected by hybridization with an oligonucleotide detection reagent.

In certain embodiments, polymorphic markers are detected by sequencing technologies. Obtaining sequence information about an individual plant identifies particular nucleotides in the context of a sequence. For SNPs, sequence information about a single unique sequence site is sufficient to identify alleles at that particular SNP. For markers comprising more than one nucleotide, sequence information about the nucleotides of the individual that contain the polymorphic site identifies the alleles of the individual for the particular site.

Various methods for obtaining nucleic acid sequence are known to the skilled person, and all such methods are useful for practicing the invention. Sanger sequencing is a well-known method for generating nucleic acid sequence information. Recent methods for obtaining large amounts of sequence data have been developed, and such methods are also contemplated to be useful for obtaining sequence information of a plant, if desired. These include pyrosequencing technology (Ronaghi, M. et al. *Anal Biochem* 267:65-71 (1999); Ronaghi, et al., *Biotechniques* 25:876-878 (1998)), e.g. 454 pyrosequencing (Nyren, P., et al. *Anal Biochem* 208:171-175 (1993)), Illumina/Solexa sequencing technology (available one the world wide web at illumina.com; see also Strausberg, R L, et al. *Drug Disc Today* 13:569-577 (2008)), and Supported Oligonucleotide Ligation and Detection Platform (SOLiD) technology (Applied Biosystems, available on the world wide web at appliedbiosystems.com); Strausberg, R L, et al. *Drug Disc Today* 13:569-577 (2008).

B. Sampling and Sorting

Oil palm nucleic acid can be obtained from any suitable tissue of an oil palm plant. For example, oil palm nucleic acid can be obtained from a leaf, a stem, a root or a seed. In some cases, the oil palm nucleic acid is obtained from endosperm tissue of a seed. In some cases, the oil palm nucleic acid is obtained in such a manner that the oil palm plant or seed is not reduced in viability or is not substantially reduced in viability. For example, in some cases, sample extraction can reduce the number of viable plants or seeds in a population by less than about 20%, 15%, 10%, 5%, 2.5%, 1%, or less. In some cases, the sample is obtained from the embryo free region of an oil palm seed.

In some embodiments, endosperm material can be extracted from a sampling zone of a seed with a needle or probe that penetrates the seed shell and enters a sampling zone and avoids an embryo containing zone. The sampled material or fluid can further be purified from contaminating maternal DNA by removing fragments of the seed shell that might be present in the endosperm sample. In some cases, endosperm DNA can then be extracted from the endosperm material or fluid. Alternatively, oil palm nucleic acid can be obtained from a seedling, an immature (e.g. non fruit bearing) plant, or a mature plant.

Samples can be extracted by grinding, cutting, slicing, piercing, needle coring, needle aspiration or the like. Sampling can be automated. For example, a machine can be used to take samples from a plant or seed, or to take samples from a plurality of plants or seeds. Sampling can also be performed manually. Further sampling methodologies are described herein.

In some embodiments, the sampling is controlled to deter contamination of the sample. For example, washing steps can be employed between sample processing steps. Alternatively, disposable or removable sample handling elements can be utilized, e.g., disposable pipetting tips, disposable receptacles or containers, or disposable blades or grinders.

In some cases, samples are purified prior to detection of VIR genotype or prediction of fruit color phenotype. For example, samples can be centrifuged, extracted, or precipitated. Additional methods for purification of plant nucleic acids are known by those of skill in the art.

In some embodiments, a seed or plant fruit color phenotype is predicted, and the seed or plant is sorted based on the predicted phenotype. For example, the seed or plant can be sorted into *nigrescens* or *virescens* seeds or plants based on their predicted phenotype. *Nigrescens* and *virescens* seeds or plants can be sorted and stored separately as breeding stock for the generation of plants with the desired fruit form phenotype. *Virescens* seeds or plants can also be planted and cultivated for the enhanced oil yield they provide. In some cases, the plant is a seed and the sorting is performed on the seed. Alternatively, the plant is a seedling and the sorting is performed on the seedling before it is planted in the field or before its use in breeding. As yet another alternative, oil palm plants that have been planted in the field for optimal palm oil yield, but are not mature enough to verify fruit color phenotype can be assayed and *nigrescens* plants can be removed from the field.

In some embodiments, a seed or plant fruit color and shell thickness phenotype is predicted, and the seed or plant is sorted based on one or both of the predicted phenotypes. For example, the seed or plant can be sorted into *nigrescens* or *virescens* seeds or plants and *dura, tenera,* or *pisifera* seeds or plants based on their predicted phenotypes. *Nigrescens* and *virescens* versions of *dura, tenera,* or *pisifera* seeds or plants can be sorted and stored separately as breeding stock for the generation of plants with the desired fruit form phenotype. Seeds or plants having, e.g., a *viriscens* and a *tenera* predicted phenotype can also be planted and cultivated for the enhanced oil yield they provide. Other combinations of fruit color and shell thickness predicted phenotypes can also be stored, separated, planted, or discarded based on their predicted phenotypes. In some cases, the plant is a seed and the sorting is performed on the seed. Alternatively, the plant is a seedling and the sorting is performed on the seedling before it is planted in the field or before its use in breeding. As yet another alternative, oil palm plants that have been planted in the field for optimal palm oil yield, but are not mature enough to verify fruit color phenotype can be assayed and *nigrescens* and/or *dura* or *pisifera* plants can be removed from the field.

Methods of polymorphism detection can be performed on any type of biological sample from the plant that contains nucleic acids (e.g., DNA, or RNA). One particular advantage of the methods is to predict the fruit color phenotype of young plants before cultivation in the field. Therefore, in some embodiments, the samples are obtained from a plant that has been germinated and then cultivated less than 1, 2, 4, 6, months or less than 1, 2, 3, 4, or 5 years. In some embodiments, the samples are obtained before the plant has been germinated (e.g., from a seed) or shortly thereafter (e.g. less than about 1, 2, 3, 4, or 5 weeks after germination).

In some embodiments, the plants are generated from i) a cross between *nigrescens* and *virescens* palms ii) the selfing of a *virescens* palm, iii) a cross between two plants having the *virescens* fruit color phenotype, iv) selfing of a *nigrescens* palm, or v) a cross between two *nigrescens* palms. Because such crosses are not 100% efficient, parent plants are not necessarily true breeding (e.g., heterozygote parents), and VIR alleles can be dominant, dominant negative, or recessive, such crosses can result in an unpredictable percentage of seeds or plants with the *virescens* fruit color phenotype. By testing seeds or plants resulting from the attempted crosses, one can reduce or eliminate non-*virescens* contaminant seeds or plants from material planted for cultivation (optionally discarding those plants that are predicted to be *nigrescens*). Alternatively, one can identify and segregate plants based on their predicted fruit color phenotype, allowing for selection and cultivation of fields of pure *nigrescens* or *virescens* plants, if desired, e.g., for later breeding purposes.

I. Systems and Machine for Sampling and/or Sorting

Machines can be utilized to carry out one or more methods described herein, prepare plant samples for one or more methods described herein, or facilitate high throughput sorting of oil palm plants.

In some cases, a machine can sort and orient seeds such that the seed are all oriented in a similar manner. The seeds for example, can be oriented such that embryo region of the seed is down and the embryo free region is oriented up. In some cases, the seeds can be placed into an ordered array or into a single line.

In some embodiments, the seed is held in pre-determined orientation to facilitate efficient and accurate sampling. For example, the machine can orient the seeds by seed shape or visual appearance. In some cases, the seed is oriented to facilitate sampling from the 'Crown' of each respective seed, containing the cotyledon and/or endosperm tissue of the seed, so that the germination viability of each seed is preserved.

In some cases, the machine can separately store plants or seeds and their extracted samples without reducing, or without substantially reducing the viability of the seeds. In some cases, the extracted samples and stored plants or seeds are organized, labeled, or catalogued in such a way that the sample and the seed from which it is derived can be determined. In some cases, the extracted samples and stored plants or seeds are tracked so that each can be accessed after data is collected. For example, a sample can be extracted from a seed and the VIR genotype determined for the sample, and thus the seed. The seed can then be accessed and planted, stored, or destroyed based on the predicted fruit color phenotype.

In some cases, the extraction and storing are performed automatically by the machine, but the genotype analysis and/or treatment of analyzed seeds performed manually or performed by another machine. As such, in some embodiments, a system is provided consisting of two or more machines for extraction of seed samples, seed sorting and storing, and prediction of fruit color phenotype.

In some cases, the plants or seed are stored in an array by the machine, such as individually in an array of tubes or wells. The plants can be sampled and/or interrogated in or from each well. The results of the sampling or interrogating can be correlated with the position of the plant in the array.

Sampling can include extraction and/or analysis of nucleic acid (e.g., DNA or RNA), magnetic resonance imaging, optical dispersion, optical absorption, ELISA, enzymatic assay, or the like.

Systems, machines, methods and compositions for seed sampling and/or sorting are further described in, e.g., U.S. Pat. Nos. 6,307,123; 6,646,264; 7,367,155; 8,312.672; 7,685,768; 7,673,572; 8,443,545; 7,998.669; 8,362,317; 8,076,076; 7,402,731; 7,600,642; 8,237,016; 8,401,271; 8,281,935; 8,241,914; 6,880,771; 7,909,276; 8,221,968; and 7,454,989. Systems, machines, methods and compositions for seed sampling and/or sorting are also further described in, e.g., U.S. Patent Application Publication NOs: 2012/180386; 2009/070891; 2013/104454, 2012/117865, 2008/289061; 2008/000815; 2011/132721; 2011/195866; 2011/0079544; 2010/0143906; and 2013/079917. Additional systems, machines, methods, and compositions for seed sampling are further described in international patent application publications WO2011/119390; and WO2011/119394.

Also provided herein are methods for using the systems, machines, methods, and compositions described herein for seed sampling or sorting. For example, a seed or set of seeds can be loaded into a seed sampler, and a sample obtained. In some cases, the seed can be stored, e.g., in an array. In some cases, the storage is performed by the machine that samples the seed. In other cases, the seed is stored by another machine, or stored manually. In some cases, DNA can be extracted from the sample. In some cases, sample can be obtained and DNA extracted by the same machine. In other cases, the DNA is extracted by another machine, or manually. The extracted DNA can be analyzed and the VIR genotype determined. In some cases, the extracted DNA is analyzed by the same machine, by another machine, or manually. In some cases, fruit color phenotype is predicted from the VIR genotype by the machine, a different machine, or manually. In some cases, stored seeds can be disposed of (e.g., cultivated or destroyed) based on the VIR genotype or predicted fruit color phenotype. In some cases, stored seeds can be disposed of based on the VIR genotype or predicted fruit color phenotype and based on their predicted shell thickness phenotype. In some cases, the seed is disposed of by the machine, a different machine, or manually.

In some cases, the seed or seeds are shipped from a customer to a service provider, analyzed, and returned. In some cases, only seeds with a predicted phenotype or phenotypes are returned. For example, only *virescens* or only *nigrescens*, or a combination thereof are returned. In other cases, seeds are sampled, and the samples are shipped from a customer to a service provider for analysis. The customer can then utilize information provided by the analysis to dispose of the seeds.

In some cases, reagents, such as the compositions described herein are provided for sampling of seeds manually or automatically. For example, endonucleases, oligonucleotide primers or probes, or a combination thereof as described herein can be provided. As another example, reaction mixtures containing reagents necessary for analysis of nucleic acid from an oil palm plant can be provided.

IV. Transgenic Plants

As discussed above, the VIR gene of palm has been discovered to control fruit color phenotype. Thus in some embodiments, plants having modulated expression of a VIR polypeptide are provided. One desirable fruit color phenotype (*virescens*, having fruit color that changes from green to reddish orange upon ripening) occurs naturally as either a homozygote (e.g., two recessive mutations of the wild-type VIR allele), or as a heterozygote (e.g., at least one dominant negative mutation of wild-type the VIR allele).

*virescens*-type VIR alleles can result in plants that do not express sufficient functional VIR. Accordingly, in some embodiments, plants having reduced level of functional VIR protein compared to a *nigrescens* plant are provided. Such plants can be generated, for example, using gene inhibition technology, including but not limited to siRNA technology, to reduce, or eliminate, endogenous VIR gene expression of an active VIR protein (e.g., in a *nigrescens* background).

Alternatively, a heterologous expression cassette (i.e., a transgene) can be introduced into a *nigrescens* background where the expression cassette promotes expression of a dominant negative VIR allele. This can be achieved, for example, by operably linking a suitable promoter to mutated VIR gene, such as those provided in SEQ ID NOS:6, 7, 9, 11, 13, or 15, or a fragment thereof that contains a Myb-like DNA binding domain. In some cases, the VIR gene or fragment utilized may contain additional sequence encoding for additional C-terminal amino acids. Alternatively, a fragment of the wild-type VIR gene (e.g., a fragment of SEQ ID NO:1) may be utilized. In yet other embodiments, a VIR gene substantially similar to the wild-type may be utilized as a dominant negative as long as it contains a mutation, such as a point mutation, that renders the C-terminal domain inactive or substantially inactive, but does not substantially interfere with one or more of the DNA binding domains. Suitable promoters that can be operably linked to the genes or gene fragments provided above include, but are not limited to strong promoters like CaMV 35S, and native promoters like the native VIR gene promoter.

A. Inhibition or Suppression of Gene Expression

Methods for controlling the fruit color trait in a palm (e.g., oil palm, coconut, or date palm) or other plant are provided by reducing expression of an endogenous nucleic acid molecule encoding a VIR polypeptide. For example, in a transgenic plant, a nucleic acid molecule, or antisense, siRNA, microRNA, or dsRNA constructs thereof, targeting a VIR gene product, or fragment thereof, or a VIR mRNA, or fragment thereof can be operatively linked to an exogenous regulatory element, wherein expression of the construct suppresses endogenous VIR expression.

A number of methods can be used to inhibit gene expression in plants. For instance, antisense technology can be conveniently used. To accomplish this, a nucleic acid segment from the desired gene is cloned and operably linked to a promoter such that the antisense strand of RNA will be transcribed. The expression cassette is then transformed into plants and the antisense strand of RNA is produced. In plant cells, it has been suggested that antisense RNA inhibits gene expression by preventing the accumulation of mRNA which encodes the protein of interest, see, e.g., Sheehy et al., *Proc. Nat. Acad. Sci. USA,* 85:8805-8809 (1988); Pnueli et al., *The Plant Cell* 6:175-186 (1994); and Hiatt et al., U.S. Pat. No. 4,801,340.

The antisense nucleic acid sequence transformed into plants will be substantially identical to at least a portion of the endogenous gene or genes to be repressed. The sequence, however, does not have to be perfectly identical to inhibit expression. For example, an antisense or sense nucleic acid molecule encoding only a portion of a VIR-encoding sequence can be useful for producing a plant in which VIR expression is suppressed. The vectors of the present invention can be designed such that the inhibitory effect applies to other proteins within a family of genes exhibiting homology or substantial homology to the target gene, or alternatively such that other family members are not substantially inhibited.

For antisense suppression, the introduced sequence also need not be full length relative to either the primary transcription product or mature mRNA (e.g., SEQ ID NO:3 or polyadenylated SEQ ID NO:3). Generally, higher homology can be used to compensate for the use of a shorter sequence. Furthermore, the introduced sequence need not have the same intron or exon pattern, and homology of non-coding segments may be equally effective. In some embodiments, a sequence of at least, e.g., 15, 20, 25 30, 50, 100, 200, or more continuous nucleotides (up to mRNA full length) substantially identical to an endogenous VIR mRNA, or a complement or reverse complement thereof, can be used.

Catalytic RNA molecules or ribozymes can also be used to inhibit expression of VIR genes. It is possible to design ribozymes that specifically pair with virtually any target RNA and cleave the phosphodiester backbone at a specific location, thereby functionally inactivating the target RNA. In carrying out this cleavage, the ribozyme is not itself altered, and is thus capable of recycling and cleaving other molecules, making it a true enzyme. The inclusion of ribozyme sequences within antisense RNAs confers RNA-cleaving activity upon them, thereby increasing the activity of the constructs.

A number of classes of ribozymes have been identified. One class of ribozymes is derived from a number of small circular RNAs that are capable of self-cleavage and replication in plants. The RNAs replicate either alone (viroid RNAs) or with a helper virus (satellite RNAs). Examples include RNAs from avocado sunblotch viroid and the satellite RNAs from tobacco ringspot virus, lucerne transient streak virus, velvet tobacco mottle virus. *Solanum nodiflorum* mottle virus and subterranean clover mottle virus. The design and use of target RNA-specific ribozymes is described in Haseloff et al. *Nature,* 334:585-591 (1988).

Another method of suppression is sense suppression (also known as co-suppression). Introduction of expression cassettes in which a nucleic acid is configured in the sense orientation with respect to the promoter has been shown to be an effective means by which to block the transcription of target genes. For an example of the use of this method to modulate expression of endogenous genes see, Napoli et al., *The Plant Cell* 2:279-289 (1990); Flavell, *Proc. Natl. Acad. Sci., USA* 91:3490-3496 (1994); Kooter and Mol, *Current Opin. Biol.* 4:166-171 (1993); and U.S. Pat. Nos. 5,034,323, 5,231,020, and 5,283.184.

Generally, where inhibition of expression is desired, some transcription of the introduced sequence occurs. The effect may occur where the introduced sequence contains no coding sequence per se, but only intron or untranslated sequences homologous to sequences present in the primary transcript of the endogenous sequence. The introduced sequence generally will be substantially identical to the endogenous sequence intended to be repressed. This minimal identity will typically be greater than about 65%, but a higher identity might exert a more effective repression of expression of the endogenous sequences. In some embodiments, the level of identity is more than about 80% or about 95%. As with antisense regulation, the effect can apply to any other proteins within a similar family of genes exhibiting homology or substantial homology and thus which area of the endogenous gene is targeted will depend whether one wished to inhibit, or avoid inhibition, of other gene family members.

For sense suppression, the introduced sequence in the expression cassette, needing less than absolute identity, also need not be full length, relative to either the primary transcription product or fully processed mRNA. This may be preferred to avoid concurrent production of some plants that are overexpressers. A higher identity in a shorter than full length sequence compensates for a longer, less identical sequence. Furthermore, the introduced sequence need not have the same intron or exon pattern, and identity of non-coding segments will be equally effective. Normally, a sequence of the size ranges noted above for antisense regulation is used.

Endogenous gene expression may also be suppressed by way of RNA interference (RNAi), which uses a double-stranded RNA having a sequence identical or similar to the sequence of the target gene. RNAi is the phenomenon in which when a double-stranded RNA having a sequence identical or similar to that of the target gene is introduced into a cell, the expressions of both the inserted exogenous gene and target endogenous gene are suppressed. The double-stranded RNA may be formed from two separate complementary RNAs or may be a single RNA with internally complementary sequences that form a double-stranded RNA. Although details of the mechanism of RNAi are still unknown, it is considered that the introduced double-stranded RNA is initially cleaved into small fragments, which then serve as indexes of the target gene in some manner, thereby degrading the target gene. RNAi is known to be also effective in plants (see. e.g., Chuang, C. F. & Meyerowitz, E. M., *Proc. Natl. Acad. Sci.* (*USA* 97: 4985 (2000); Waterhouse et al., *Proc. Natl. Acad. Sci. USA* 95:13959-13964 (1998); Tabara et al. *Science* 282:430-431 (1998)). For example, to achieve suppression of the expression of a DNA encoding a protein using RNAi, a double-stranded RNA having the sequence of a DNA encoding the protein, or a substantially similar sequence thereof (including those engineered not to translate the protein) or fragment thereof, is introduced into a plant of interest. The resulting plants may then be screened for a phenotype associated with the target protein and/or by monitoring steady-state RNA levels for transcripts encoding the protein. Although the genes used for RNAi need not be completely identical to the target gene, they may be at least 70%, 80%, 90%, 95% or more identical to the target gene sequence. See, e.g., U.S. Patent Publication No. 2004/0029283. The construct encoding an RNA molecule with a stem-loop structure that is unrelated to the target gene and that is positioned distally to a sequence specific for the gene of interest may also be used to inhibit target gene expression. See, e.g., U.S. Patent Publication No. 2003/0221211.

The RNAi polynucleotides may encompass the full-length target RNA or may correspond to a fragment of the target RNA. In some cases, the fragment will have fewer than 100, 200, 300, 400, 500 600, 700, 800, 900 or 1,000 nucleotides corresponding to the target sequence. In addition, in some embodiments, these fragments are at least, e.g., 50, 100, 150, 200, or more nucleotides in length. In some cases, fragments for use in RNAi will be at least substantially similar to regions of a target protein that do not occur in other proteins in the organism or may be selected to have as little similarity to other organism transcripts as possible, e.g., selected by comparison to sequences in analyzing publicly-available sequence databases.

Expression vectors that continually express siRNA in transiently- and stably-transfected plants have been engineered to express small hairpin RNAs, which get processed in vivo into siRNAs molecules capable of carrying out gene-specific silencing (Brummelkamp et al., *Science* 296: 550-553 (2002), and Paddison, et al., *Genes & Dev.* 16:948-958 (2002)). Post-transcriptional gene silencing by double-stranded RNA is discussed in further detail by Hammond et al. *Nature Rev Gen* 2: 110-119 (2001), Fire et al. *Nature* 391: 806-811 and Timmons and Fire *Nature* 395: 854 (1998).

One of skill in the art will recognize that using technology based on specific nucleotide sequences (e.g., antisense or sense suppression, siRNA, microRNA technology, etc.), families of homologous genes can be suppressed with a single sense or antisense transcript. For instance, if a sense or antisense transcript is designed to have a sequence that is conserved among a family of genes, then multiple members of a gene family can be suppressed. Conversely, if the goal is to only suppress one member of a homologous gene family, then the sense or antisense transcript should be targeted to sequences with the most variance between family members.

Yet another way to suppress expression of an endogenous plant gene is by recombinant expression of a microRNA that suppresses a target (e.g., a VIR gene). Artificial microRNAs are single-stranded RNAs (e.g., between 18-25 mers, generally 21 mers), that are not normally found in plants and that are processed from endogenous miRNA precursors. Their sequences are designed according to the determinants of plant miRNA target selection, such that the artificial microRNA specifically silences its intended target gene(s) and are generally described in Schwab et al., *The Plant Cell* 18:1121-1133 (2006) as well as the internet-based methods of designing such microRNAs as described therein. See also, US Patent Publication No. 2008/0313773.

B. Use of Nucleic Acids of the Invention to Enhance Gene Expression

Nucleic acid sequences encoding all or an active part of a VIR polypeptide (including but not limited to polypeptides substantially identical to SEQ ID NOS:5, 8, 10, 12, or 14, or VIR polypeptides having a functional DNA binding domain and one or more non-functional domains (e.g., a VIR polypeptide truncated C-terminal to one or more DNA binding domains), which when expressed control fruit color) can be used to prepare expression cassettes that enhance, or increase expression of dominant negative VIR alleles. Alternatively, nucleotide sequences encoding all or an active part of a VIR polypeptide (including but not limited to polypeptides substantially identical to SEQ ID NO:4) can be used to prepare expression cassettes that enhance or increase expression of VIR. Where overexpression of a gene is desired in a background that contains a copy of the same gene or a copy of a gene substantially similar, the desired VIR gene from a different species may be used to decrease potential sense suppression effects. Alternatively, co-suppression may be reduced by introducing silent mutations into the VIR gene of the expression cassette that do not alter the amino acid coding sequence, but reduce the similarity to the endogenous gene.

Any of a number of means well known in the art can be used to increase VIR activity in plants. Any organ can be targeted, such as shoot vegetative organs/structures (e.g. leaves, stems and tubers), roots, flowers and floral organs/structures (e.g. bracts, sepals, petals, stamens, carpels, anthers and ovules), seed (including embryo, endosperm, and seed coat) and fruit. Alternatively, a VIR gene can be expressed constitutively (e.g., using the CaMV 35S promoter).

One of skill will recognize that the polypeptides encoded by the genes of the invention, like other proteins, have different domains which perform different functions. Thus, the gene sequences need not be full length, so long as the desired functional domain of the protein is expressed.

V. Preparation of Recombinant Vectors

In some embodiments, to use isolated sequences in the above techniques, recombinant DNA vectors suitable for transformation of plant cells are prepared. Techniques for transforming a wide variety of higher plant species are well known and described in the technical and scientific literature. See, for example. Weising et al. *Ann. Rev. Genet.* 22:421-477 (1988). A DNA sequence coding for the desired polypeptide, for example a cDNA sequence encoding a full length protein, will preferably be combined with transcriptional and translational initiation regulatory sequences which will direct the transcription of the sequence from the gene in the intended tissues of the transformed plant.

For example, for overexpression, a plant promoter fragment may be employed which will direct expression of the gene in all tissues of a regenerated plant. Such promoters are referred to herein as "constitutive" promoters and are active under most environmental conditions and states of development or cell differentiation. Examples of constitutive promoters include the cauliflower mosaic virus (CaMV) 35S transcription initiation region, the 1'- or 2'-promoter derived from T-DNA of *Agrobacterium tumefaciens*, and other transcription initiation regions from various plant genes known to those of skill.

Alternatively, the plant promoter may direct expression of the polynucleotide of the invention in a specific tissue (tissue-specific promoters) or may be otherwise under more precise environmental control (inducible promoters). Examples of tissue-specific promoters under developmental control include promoters that initiate transcription only in certain tissues, such as fruit, seeds, or flowers. Examples of environmental conditions that may affect transcription by inducible promoters include anaerobic conditions, elevated temperature, or the presence of light.

If proper polypeptide expression is desired, a polyadenylation region at the 3'-end of the coding region should be included. The polyadenylation region can be derived from the natural gene, from a variety of other plant genes, or from T-DNA.

The vector comprising the sequences (e.g., promoters or coding regions) from genes of the invention can optionally comprise a marker gene that confers a selectable phenotype on plant cells. For example, the marker may encode biocide resistance, particularly antibiotic resistance, such as resistance to kanamycin, G418, bleomycin, hygromycin, or herbicide resistance, such as resistance to chlorosluforon or Basta.

VIR nucleic acid operably linked to a promoter is provided that, in some embodiments, is capable of driving the transcription of the VIR coding sequence in plants, such as a wild-type VIR coding sequence or a dominant negative VIR coding sequence. The promoter can be, e.g., derived from plant or viral sources. The promoter can be, e.g., constitutively active, inducible, or tissue specific. In construction of recombinant expression cassettes, vectors, transgenics, of the invention, a different promoters can be chosen and employed to differentially direct gene expression, e.g., in some or all tissues of a plant or animal. In some embodiments, as discussed above, desired promoters are identified by analyzing the 5' sequences of a genomic clone corresponding to a VIR gene as described here. For examples, desired promoters may be found in the region of SEQ ID NOS:1 or 17 that are 5' of the VIR gene.

VI. Production of Transgenic Plants

DNA constructs of the invention may be introduced into the genome of the desired plant host by a variety of conventional techniques. For example, the DNA construct may be introduced directly into the genomic DNA of the plant cell using techniques such as electroporation and microinjection of plant cell protoplasts, or the DNA constructs can be introduced directly to plant tissue using ballistic methods, such as DNA particle bombardment. Alternatively, the DNA constructs may be combined with suitable T-DNA flanking regions and introduced into a conventional *Agrobacterium tumefaciens* host vector. The virulence functions of the *Agrobacterium tumefaciens* host will direct the insertion of the construct and adjacent marker into the plant cell DNA when the cell is infected by the bacteria.

Various palm transformation methods have been described. See, e.g., Masani and Parveez, *Electronic Journal of Biotechnology* Vol. 11 No. 3, Jul. 15, 2008; Chowdury et al., *Plant Cell Reports*, Volume 16, Number 5, 277-281 (1997).

Microinjection techniques are known in the art and well described in the scientific and patent literature. The introduction of DNA constructs using polyethylene glycol precipitation is described in Paszkowski et al. *EMBO J.* 3:2717-2722 (1984). Electroporation techniques are described in Fromm et al. *Proc. Natl. Acad. Sci. USA* 82:5824 (1985). Ballistic transformation techniques are described in Klein et al. *Nature* 327:70-73 (1987).

*Agrobacterium tumefaciens*-mediated transformation techniques, including disarming and use of binary vectors, are well described in the scientific literature. See, for example Horsch et al. *Science* 233:496-498 (1984), and Fraley et al. *Proc. Natl. Acad. Sci. USA* 80:4803 (1983).

Transformed plant cells that are derived from any transformation technique can be cultured to regenerate a whole plant that possesses the transformed genotype and thus the desired phenotype. Such regeneration techniques rely on manipulation of certain phytohormones in a tissue culture growth medium, optionally relying on a biocide and/or herbicide marker that has been introduced together with the desired nucleotide sequences. Plant regeneration from cultured protoplasts is described in Evans et al., *Protoplasts Isolation and Culture, Handbook of Plant Cell Culture*, pp. 124-176, MacMillilan Publishing Company, New York, 1983; and *Binding, Regeneration of Plants, Plant Protoplasts*, pp. 21-73, CRC Press, Boca Raton, 1985. Regeneration can also be obtained from plant callus, explants, organs, or parts thereof. Such regeneration techniques are described generally in Klee et al. *Ann. Rev. of Plant Phys.* 38:467-486 (1987).

The nucleic acids of the invention can be used to confer desired traits on essentially any plant. Thus, the invention has use over a broad range of plants, including species from the genera *Asparagus, Atropa, Avena, Brassica, Citrus, Citrullus, Capsicum, Cucumis, Cucurbita, Daucus, Fragaria, Glycine, Gossypium, Itelianthus, Ileterocallis, Ilordeum, Hysocyamus, Lactuca, Linum, Lolium, Lycopersicon, Malus, Manihot, Majorana, Medicago, Nicotiana, Oryza, Panieum, Pannesetum, Persea, Pisum, Pvrus, Prunus, Raphanus. Secale, Senecio, Sinapis, Solanum, Sorghum, Trigonella, Triticum, Vitis, Vigna,* and, *Zea*. Plants that fruit, and have use in the present invention, include but are not limited to dicotyledons and monocotyledons including but not limited to palm, such as oil palm.

VII. Kits

Described herein are kits for the prediction of fruit color phenotype of an oil palm plant. The kit can contain one or more endonucleases. In some cases, each endonuclease is specific for one or more VIR alleles. For example, each endonuclease can recognize and cleave a sequence at or near one or more VIR alleles or a portion thereof, but does not recognize or cleave a sequence at or near at least one other VIR allele or a portion thereof. In some cases, the one or more endonucleases is AseI, AluI, or an isoschizomer thereof.

The kit can contain one or more oligonucleotide primers for amplification at or near the VIR locus. For instance, the kit can include at least one primer that primes amplification of at least a portion of one or more of the following VIR alleles: SEQ ID NOS:1, 3, 7, 9, 11, 13, or 15, or a primer pair that generates an amplicon comprising at least a portion of SEQ ID NOS:1, 3, 7, 9, 11, 13, or 15.

In some cases, the primer is specific for one or more VIR alleles. For example, the primer can hybridize to, and prime polymerization of, a region at or near one or more VIR alleles but does not hybridize to, or primer polymerization of, a region at or near one or more other VIR alleles. In other cases, the primer can hybridize to, or prime polymerization of, a region at or near (e.g., within less than about 10,000 bp; 5,100 bp; 1,000 bp; 500 bp; 250 bp; 100 bp; 50 bp; 25 bp: 15 bp; or fewer) a AseI, AluI, or ApoI site of a VIR allele. In some cases, the oligonucleotide primer contains at least 10, 12, 15 or more contiguous nucleotides comprising a portion of SEQ ID NOS:1, 3, 7, 9, 11, 13, 15, or 17 or a reverse complement thereof. In some cases, the primer can provide, e.g. alone or in combination with other primers, for amplification such as isothermal amplification or PCR.

In some cases, the kit can include a primer pair for amplification by, e.g. PCR or an isothermal amplification method. In some cases, the primer pair can specifically hybridize to the oil palm genome and flank at least about 8, 10, 12, 15, 20, 25, 30, 40, 50, 60, 70, 80, 90, 100, 125, 150, 175, 200, 250, 300, 350, 400, 450, 500, 600, 700, 800, 1000, 1500, 2000, 2500, 3000, 5000, 7500, or 10000 or more continuous nucleotides at or near the VIR locus. The primer pair can specifically amplify one or more VIR alleles and not amplify one or more VIR alleles, or the primer pair can amplify all naturally occurring VIR alleles.

The kit can also include control polynucleotides as described herein. For example, the kit can include a polynucleotide containing wild-type VIR nucleic acid or a portion thereof (e.g., a nucleic acids that contains SEQ ID NO:1 or 3 or a portion thereof). As another example, the kit can include one or more polynucleotides containing mutant VIR nucleic acid or a portion thereof (e.g., one or more nucleic acids encoding SEQ ID NOS:7, 9, 11, 13, or 15, or portions thereof) The kit can also include any of the reagents, proteins, oligonucleotides, etc. described herein. For instance, the control polynucleotides can be identical to expected amplicons based on the amplification primers described above (e.g., spanning the target sequence including at least a portion of one or more of SEQ ID NOS:1, 7, 9, 11, 13, 15, or 17), and/or portions of such amplicons that would occur upon cleavage with the endonucleases as described above.

In some embodiments, a kit can include compositions for prediction of fruit color phenotype and shell thickness phenotype (e.g., *dura, pisifera*, and *tenera*). In some cases, the fruit color and shell thickness phenotypes can be predicted at the same time, e.g., as part of a single-pass sampling, identification, and/or sorting method. In some cases, the fruit color and shell thickness phenotypes can be predicted using the same nucleic acid sample. For example, a nucleic acid sample can be extracted from a portion of a plant or a seed and teated for the presence or absence of a *viriscens* allele or a polymorphism in linkage disequilibrium with a *virescens* or *nigrescens* allele and tested to predict the shell thickness phenotype of the plant or seed. Methods, compositions, and kits for predicting SHELL thickness include, but are not limited to, determining the genotype at the SHELL locus, determining the genotype of a polymorphism in linkage disequilibrium with the SHELL locus, determining the genotype of a gene that controls the shell thickness phenotype (e.g., a gene encoding a MADS box protein), or identifying the presence or absence of a polymorphism in linkage disequilibrium with a gene that controls the shell thickness phenotype. Methods, compositions and kits for predicting shell thickness are described, e.g., in PCT Publication No. 2013/142187; U.S. Patent Application No. 61/612,885, filed on Mar. 19, 2012; U.S. Patent Application No. 61/847,853 filed on Jul. 18, 2013; and U.S. Application No. 61/856,433, filed on Jul. 19, 2013, the contents of which are hereby incorporated by reference in their entirety for all purposes.

EXAMPLES

The following examples are offered to illustrate, but not to limit the claimed invention.

Example 1

Identification and Characterization of the Gene Controlling the Fruit Color Phenotype in Oil Palm Introduction Commercially grown oil palm (*Elaeis guineensis*) is an outbreeding diploid species (2n=32) of West African origin (Zeven, A. C. J. Niger. Inst. Oil Palm Res. 4, 218-225 (1965); Hartley, C. In: *The Oil Palm*. 47-94 (Longman, 1988); Singh, R. et al. Nature 500, 335-339 (2013)). We recently reported the genome sequences of *F. guineensis* and the South American oil palm, *E. oleifera* (Singh, R. et al. Nature 500, 335-339 (2013)), as well as the discovery of the oil palm SHELL gene, a homologue of SEEDSTICK (STK), responsible for oil palm fruit forms (Singh, R. et al. Nature 500, 340-344 (2013)). We next sought to identify the genetic basis of oil palm fruit colour.

Fruit colour is an important trait in terms of fruit harvesting and, therefore, oil yield. The majority of oil palms produce either *nigrescens* or *virescens* fruit type (Hartley, C. In: *The Oil Palm*. 47-94 (Longman, 1988)). *Nigrescens* fruits are usually deep violet to black at the apex and yellow at the base when unripe, with minimal change in colour upon ripening (FIG. 1*a, c*). *Virescens* fruits are green when unripe, and change to orange when the bunch matures (FIG. 1*b, c*). For *nigrescens* palms, harvesters rely on the presence of detached fruits on the ground to determine that bunches are ripe. However, as *virescens* fruits undergo a more profound colour change upon ripening, it is easier to identify ripe bunches, particularly in tall palms where they can be obscured by fronds, thus minimizing yield loss due to fallen fruits or harvesting of unripe bunches. Both *nigrescens* and *virescens* palms occur in natural groves. Although the *virescens* trait is dominant, the number of *virescens* palms found in natural populations is small, with frequencies ranging from below 1% in Nigeria and Angola (Hartley, C. In: *The Oil Palm*. 47-94 (Longman, 1988)) to up to 50% in one location in Congo (Rajanaidu, N. In: *Proc. Int. Workshop. "Oil palm germplasm and utilization". Palm Oil Res. Inst. Malaysia*, 59-83 (1986)). *Virescens* palms were used in ancient ceremonial rites (Zeven, A. C. J. Niger. Inst. Oil Palm Res. 4, 218-225 (1965)), explaining their occurrence among wild-type *nigrescens* palms, and "Ojuku" plants matching the description of *virescens* palms were reportedly used in tribal sacrificial ceremonies in West Africa (ANON. Bulletin of Miscellaneous Information, Royal Botanic Gardens, Kew, 33-49 (1909); Farquhar, J. H. J. In: *The oil palm and its varieties*. 1-11 (Whitehall Gardens, S. W., 1913)).

Methods

Plant Materials and Germplasm Collection

The mapping family used was derived from the self pollination of a high iodine value *virescens tenera* palm T128 (accession number MPOB 371) which has been described in detail in Singh, R. et al. Nature 500, 340-344 (2013). An additional 108 palms derived from six families of different genetic backgrounds (Table 1) were available, part of which (81 palms) were used to confirm marker-trait association, while 96 of these palms were used to sequence the entire *virescens* gene. Similarly, an additional collection of advanced breeding lines (AVROS) (43 *nigrescens*) and germplasm material (87 *virescens* and 353 *nigrescens*) collected from seven countries in Africa were also sequenced to confirm the identity of the *virescens* gene and identify additional mutations within VIR. All germplasm materials were collected under bilateral agreements with the respective countries and followed closely the Convention on Biological Diversity (1992). The processing of leaf samples and DNA extraction were carried out as previously described in Singh, R. et al. Nature 5(00, 340-344 (2013).

Genetic Mapping

A total of 240 palms of the mapping family were available for DNA extraction at the start of this study. Of these, 32 palms could not be phenotyped with confidence, as the palms had been cut down or succumbed to disease before the fruit exocarp colour could be determined or re-confirmed. Of the 208 palms that were successfully phenotyped, 160 were identified as *virescens* palms and 48 as *nigrescens* palms. However, all 240 available palms were genotyped with 4,451 SNP markers using the Illumina iSelect assay (Illumina), 3 RFLP and 197 SSR markers. The genetic map was constructed essentially as described in Singh, R. et al. *Nature* 500, 340-344 (2013), using JoinMap4.0.

Forward and reverse primers included M13 Forward or M13 Reverse sequence tags, respectively. Amplicons were treated with exonuclease 1 (New England Biolabs) and shrimp alkaline phosphatase (Affymetrix) under standard conditions. Amplicons were sequenced using a combination of M13 primers and internal primers (internal primer sequences available upon request). Sequencing was performed on an ABI 3730 capillary DNA sequencer using big dye terminator VS 3.1 chemistry (LIFE Technologies). Local assemblies of each amplicon were constructed with PHRAP and reviewed

TABLE 1

| No. | Cross Type | Trial No. | Location | No. Palms Tested | Genetic Background |
|---|---|---|---|---|---|
| 1 | Tenera (T) × Tenera (T) | MKPOB PK575 | MPOB-UKM Station, Bangi, Selangor | 21 | [0.151/128] × [AAR 0.127/13] |
| 2 | Tenera (T) × Tenera (T) | TT132 | United Plantations, Teluk Intan, Perak | 12 | [Yangambi] × [Jenderata TT-Yocoboue] |
| 3 | Tenera (T) × Tenera (T) | TT108 | United Plantations, Teluk Intan, Perak | 12 | [Jenderata TT-Yocoboue] × [Nigerian Tenera] |
| 4 | Dura (D) × Tenera (T) | DT35 | United Plantations, Teluk Intan, Perak | 22 | [Ulu-Bernam-Klanang Baru Deli Dura] × [Nigerian Tenera] |
| 5 | Dura (D) × Tenera (T) | DT38 | United Plantations, Teluk Intan, Perak | 20 | [Klanang Baru-Ulu Remis Deli Dura] × [Nigerian Tenera] |
| 6 | Dura (D) × Pisifera (P) | DP454 | United Plantations, Teluk Intan, Perak | 21 | [Ulu Remis Deli Dura] × [Yangambi Nifor] |

[1]Parenthesis preceding the symbol 'x' denotes the female parent..
[2]In the populations listed above, the female parent of MPOB PK575 is palm T128, which was self-pollinated to generate the population used for map construction in this study.
[3]The family TT132 was used to verify marker-trait linkage, but not used to amplify the virescens gene for confirmation via sequencing.

Fruit Colour Phenotyping

The fruit exocarp colour was determined on ripe bunches, following the ripeness criteria described in Corley and Tinker. In: *The Oil Palm* 4th edn, 287-325 (Blackwell Science, 2003), at least one loose fruit per bunch (irrespective of plant height). The bunch was harvested from the plant and a minimum of five fruitlets were stripped from the bunch. Visual observation was made of the exocarp, and fruits were classified as *nigrescens* (black at upper half and red at bottom) or *virescens* (orange with a greenish top). In this study at least two independent attempts were made to determine fruit colour of the mapping family as well as the breeding populations. With respect to the germplasm collection, fruit colour observations were made only once.

Genome and Transcriptome Sequencing

Twelve independent T128 progeny palms (5 *nigrescens* and 7 *virescens*) were sequenced to 20× raw sequence coverage by HISEQ 2000 (Illumina). Library construction, sequencing and assemblies were performed as described in Singh, R. et al. *Nature* 500, 335-339 (2013). For transcriptome sequencing, RNA was extracted from 10-20 fruits from two plants (1 *nigrescens* and 1 *virescens*) at 8 WAA. Three replicate RNA extractions were performed for each fruit pool. TrueSeq (Illumina) libraries were constructed and sequenced by HISEQ 2000 as described in Singh, R. et al. *Nature* 500, 340-344 (2013).

VIR Sanger Sequencing

The entirety of the VIR gene was amplified by PCR from oil palm genomic DNA using forward primer sequence, (SEQ ID NO:18) GCGTACGTGGAACCACAA, and reverse primer sequence, (SEQ ID NO:19) CTCCATCCTGGTGAGAAAGCGT, generating a single ~2.9 Kb amplicon.

in CONSED. Consensus sequence for each palm was aligned to the reference *pisifera* genome sequence (Singh, R. et al. *Nature* 500, 335-339 (2013)). Data were analyzed to determine the integrity of the coding sequence and resulting putative translated polypeptide of the PAP1-like gene for each palm. A large percentage of the palms analyzed were part of the 110,000 diverse germplasm collection available at MPOB.

Phylogenetic Analysis

A collection of R2R3 MYBs from previously studied plant species were selected based on their similarity to the VIR protein. These sequences were aligned using the ClustalX program, and the highly conserved R2R3 domains were then processed using the promlk program from the phylip package.

Pigment Extraction and Spectrophotometric Analysis

Acidified methanol (1% HCl, v/v) was added to ground exocarp slices of *E. guineensis* (15 WAA *nigrescens* and *virescens* fruits) and stirred to ensure efficient extraction of pigments. The extracts were centrifuged at 3,000×g in an Eppendorf 5810R centrifuge to remove debris. The supernatants were removed and filtered prior to further analysis. UV-Visible absorption spectra were recorded from 230-780 nm at 10 nm intervals using a U-2800 double beam scanning UV-Visible spectrophotometer (Hitachi, Japan) to determine the presence, if any, of anthocyanins.

High Performance Liquid Chromatography (HPLC)

HPLC was performed on a Waters 250× 4.6 mm i.d., 5 μm, Atlantis dC18 column using a Waters Alliance W 2695 Separation Module (Waters. Assoc., Milford, USA) equipped with a 2996 photodiode array detector. A gradient mobile phase comprising Solvent (A), 9% acetonitrile, 10% formic acid, 90% water (v/v/v) and Solvent (B) 36% acetonitrile, 10% formic acid, 54% water (v/v/v) was used. The elution gradient was 0-3 min, 100% A., 3-30 min 71.5% A., 28.5% B., 30-45 min, 71.5% A., 28.5% B. The flow rate was 1.0 mL per min and injection volume was 20 μL. Absorbance spectra were collected for all peaks.

Results

Oil palm is an out-breeding species, and as such, a high degree of heterozygosity is expected. A population of 240 palms derived from the self-pollination of the *tenera* palm, T128 (0.151/128×0.151/128), from Malaysian Palm Oil Board's (MPOB) Nigerian germplasm collection (Rajanaidu, N. In: Proceedings of the 12th Plenary Meeting of Association for the Taxonomic Study of the flora of tropical Africa (AETFAT), Mitteilingen Inst. Allg. Bot. Hamburg, Germany, pp 39-52 (1990); Cheah. S. et al. In: Proceedings of the 1999 PORIM International Palm Oil Conference (eds Darus, K., Chan, K. W and Sharithh, S. R. S. A) Palm Oil Research Institute of Malaysia, pp 297-320 (1999); Singh, R. et al. *Asia Pac. J. Mol. Biol. Biotechnol.* 16, 53-63 (2008)) was used to generate a genetic linkage map (Singh, R. et al. *Nature* 500, 335-339 (2013); Singh, R. et al. *Nature* 500, 340-344 (2013)). In addition, a subset of 81 palms from six independent crosses (Table 1) was used to confirm marker linkage. Markers were scored as co-dominant, segregating in a 1:2:1 ratio in most cases, while the *virescens* phenotype also showed the expected 3:1 segregation ratio in the mapping population (Table 2).

TABLE 2

Analysis of palms for fruit-colour

| Number of palms genotyped# | Expected Ratio | | Observed Numbers | | | |
|---|---|---|---|---|---|---|
| | *Nigrescens* | *Virescens* | *Nigrescens* | *Virescens* | Total# | $\chi^2$ |
| 240 | 1 | 3 | 48 | 160 | 208 | 0.41 |

There was a discrepancy between the total number of palms genotyped and the number observed for fruit-colour because some of the palms could not be phenotyped for various reasons.

Figure 2:
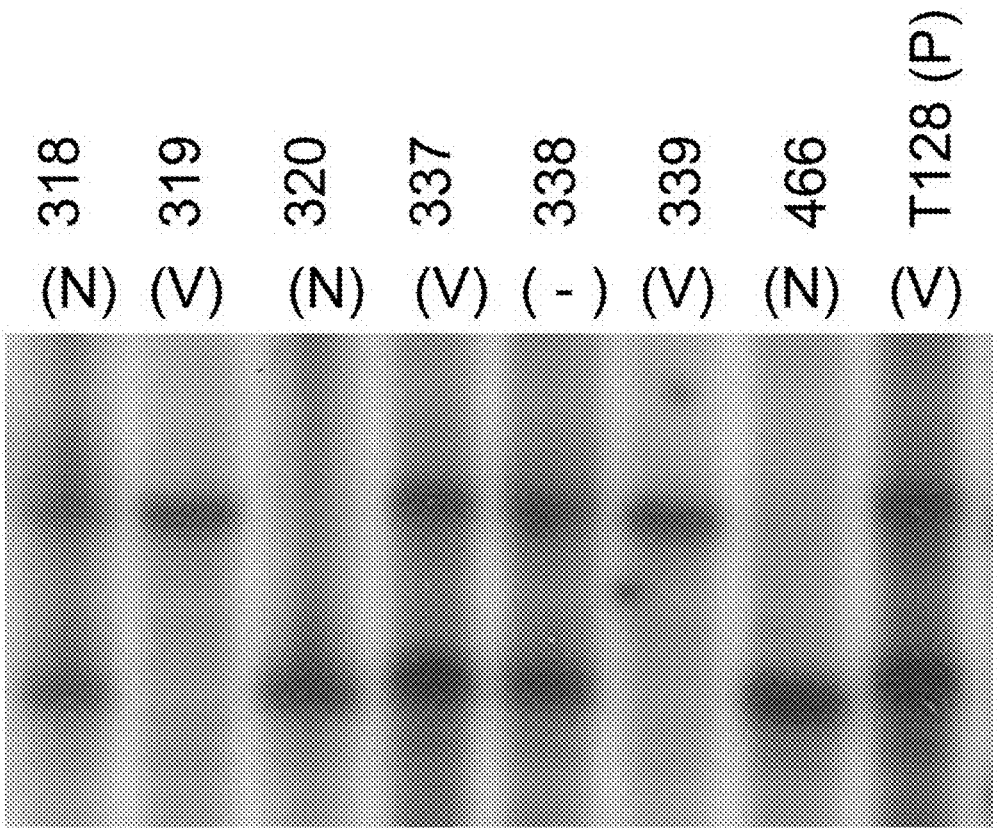
FIG. 2: Segregation of the RFLP marker, MET16, compared to that of the fruit color gene in the mapping population. DNA from a subset of the mapping population was digested with BamHI and analyzed by Southern blotting with the MET16 probe. The majority of the *virescens* fruit (93%) matched with the homozygous (top segregating band present) or heterozygous (both the segregating bands present) profile of the probe. At the same time, a very large proportion of the *nigrescens* fruits showed a profile consistent with only the bottom segregating band being present (homozygous for the wild type allele). N, *nigrescens* fruits. V, *virescens* fruits. Palm identification numbers are indicated above. Symbol "–" indicates a palm for which fruit colour could not be determined in the field.

Three informative RFLP markers were genotyped on the entire mapping population, and 197 SSR loci that were polymorphic in the mapping population were identified. Of 4,451 SNPs screened, 711 were used in map construction. The locus for the *virescens* gene (VIR) was located on linkage group 1 (Chromosome 1), with the RFLP marker MET 16 being the most tightly linked (Tables 3 and 4, FIG. 2).

TABLE 3

Linkage of SNP markers to the VIR gene locus in the mapping family and to Scaffolds in the Reference Genome Sequence

| Marker | No. of Palms with Genotype and Phenotype | No. of Palms Matching Expected Profile | No. of Recombinants | % Predictability | Scaffold |
|---|---|---|---|---|---|
| SNPM01649y | 205 | 146 | 59 | 71% | sc00408 |
| SNPM04083x | 207 | 162 | 45 | 78% | sc01152 |
| SNPM02176x | 207 | 166 | 41 | 80% | sc00231 |
| SNPM03563x | 207 | 164 | 43 | 79% | sc00015 |
| SNPM00066x | 206 | 175 | 31 | 85% | sc00015 |
| SNPM00257_1y | 208 | 177 | 31 | 85% | co228588 |
| SNPM02655y | 207 | 183 | 24 | 88% | sc00125 |
| SNPM00387x | 206 | 185 | 21 | 90% | sc00007 |
| SNPM04941x | 206 | 191 | 15 | 93% | sc00007 |
| SNPM00572y | 205 | 190 | 15 | 93% | sc00007 |
| SNPM02867y | 206 | 192 | 14 | 93% | sc00007 |
| SNPM02708y | 206 | 192 | 14 | 93% | sc00007 |
| SNPM03010y | 206 | 196 | 10 | 95% | sc00007 |
| SNPM01250x | 206 | 197 | 10 | 95% | sc00007 |
| SNPM01237x | 207 | 197 | 10 | 95% | sc00007 |
| MET16x | 200 | 191 | 9 | 96% | sc00007 |
| VIR | | | | | |
| sOleiSc00009x | 204 | 193 | 11 | 95% | sc00007 |
| sMg00228x | 205 | 193 | 12 | 94% | sc00327 |
| SNPM00383x | 204 | 190 | 14 | 93% | sc00327 |
| SNPM02400x | 202 | 189 | 13 | 94% | sc00942 |
| SNPM04251x | 207 | 187 | 20 | 90% | sc00031 |
| SNPM00013y | 208 | 186 | 22 | 89% | sc00031 |
| SNPM00012y | 208 | 186 | 22 | 89% | sc00031 |
| sEg00164x | 204 | 179 | 25 | 88% | sc00031 |
| SNPM04365y | 207 | 179 | 28 | 86% | sc00031 |
| SNPM04665y | 206 | 178 | 28 | 86% | sc00102 |

TABLE 3-continued

Linkage of SNP markers to the VIR gene locus in the mapping family and to Scaffolds in the Reference Genome Sequence

| Marker | No. of Palms with Genotype and Phenotype | No. of Palms Matching Expected Profile | No. of Recombinants | % Predictability | Scaffold |
|---|---|---|---|---|---|
| SNPM04690x | 207 | 175 | 32 | 85% | sc00102 |
| SNPM00498x | 206 | 167 | 39 | 81% | sc00093 |
| SNPM01470x | 206 | 164 | 42 | 80% | sc00144 |
| SNPM04247x | 205 | 160 | 45 | 78% | sc00101 |
| SNPM01475y | 205 | 156 | 49 | 76% | sc00101 |
| SNPM00224y | 207 | 156 | 51 | 75% | co413678 |
| SNPM04284x | 206 | 149 | 57 | 72% | sc19981 |
| SNPM02318x | 205 | 148 | 57 | 72% | sc00069 |
| SNPM00461y | 206 | 147 | 59 | 71% | sc00069 |
| SNPM02596x | 206 | 149 | 57 | 72% | sc00363 |
| SNPM00197_1y | 208 | 145 | 63 | 70% | sc00069 |
| SNPM04508x | 206 | 141 | 65 | 68% | sc00019 |
| SNPM01129y | 205 | 138 | 67 | 67% | sc00019 |
| SNPM03276y | 205 | 136 | 69 | 66% | sc00019 |
| SNPM00368y | 208 | 131 | 77 | 63% | sc00080 |
| SNPM00340x | 202 | 135 | 67 | 67% | sc00080 |

TABLE 4

Correlation of *virescens* and *nigrescens* palms with the banding profile for probe MET16 in a subset of the T128 mapping population

| No. of palms with field data | V (1) | V — N (2) | N (3) | $\chi^2$ | No. of palms with fruit-colour-not matching banding patterns Vir | Nig |
|---|---|---|---|---|---|---|
| 125 | 28 | 62 | 21 | 2.40 | 1 | 4 |

*No. of palms for which the RFLP profile was not clear/missing data: 9

Linkage of MET16 to the *virescens* trait was further tested in the 81 plants, resulting in 95% accuracy for distinguishing between *nigrescens* and *virescens* fruit traits (Table 5).

TABLE 5

Linkage of RFLP marker MET16 to the fruit-colour locus in six different families

| Probe | Trait | No. of Palms Tested | No of Palms matching expected profiles | No. of Recombinants |
|---|---|---|---|---|
| MET16 | Fruit-colour (vir) | 81 | 77 | 4 |

Figure 3:
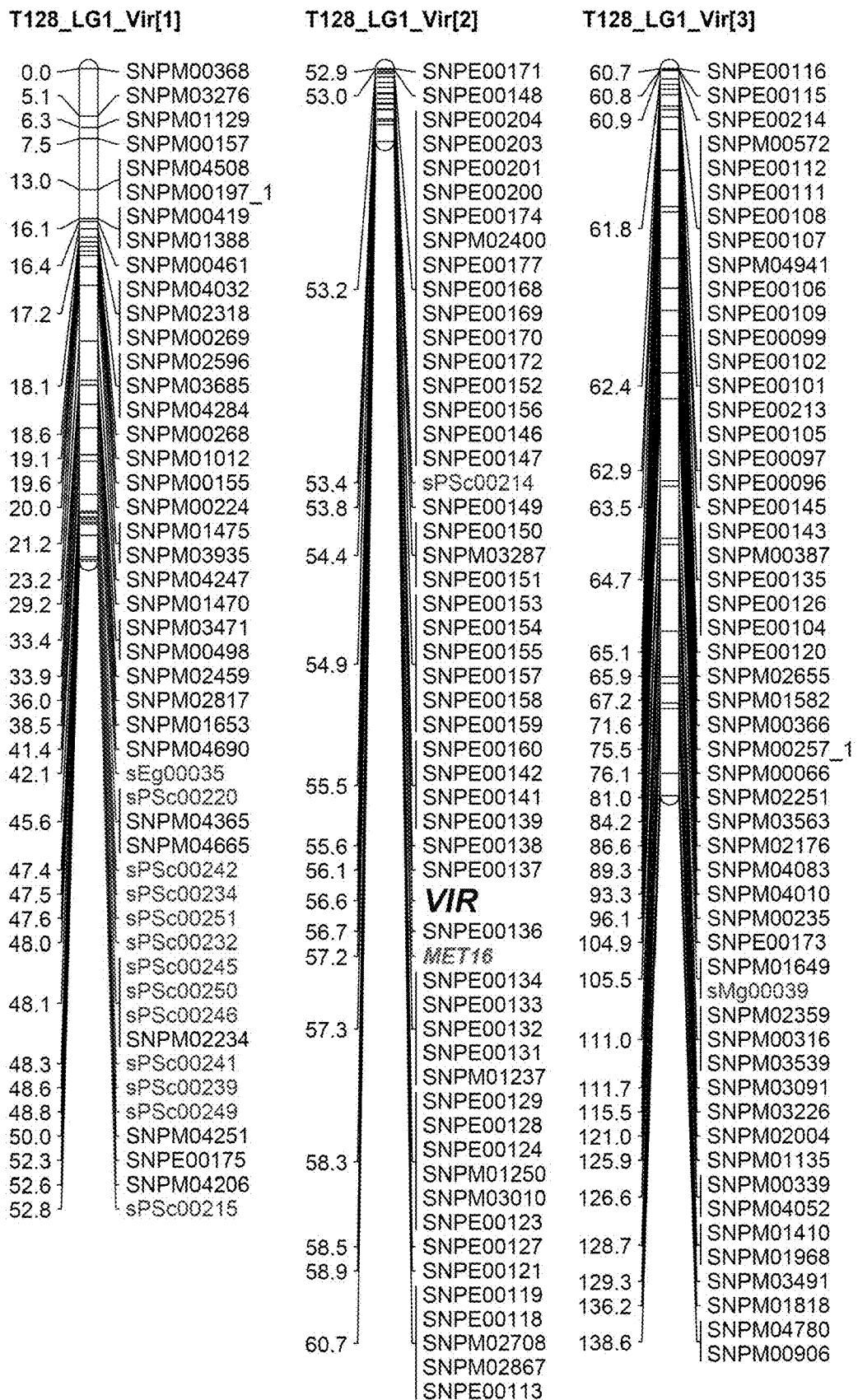
FIG. 3: Linkage group 1 of the genetic linkage map of the VIR locus. The VIR locus is shown as "VIR," SNP markers are designated "SNPM#," where "#" denotes a number, the RFLP marker is designated "MET16," and the simple sequence repeat (SSR) markers are designated with a lower case "s" followed by "Eg," "PSc," or "Mg," followed by a number.

Markers flanking the VIR candidate locus were mapped by sequence similarity to the *E. guineensis* (*pisifera*) reference genome assembly and localized to assembly scaffold 7 (p3-sc00007). A tiling path of BAC contigs corresponding to scaffold 7 was selected from a high-information content physical map of *pisifera* and sequenced. Additional SNP assays were designed from an improved assembly corresponding to scaffold 7 and genotyped. Markers mapping close to the VIR locus were identified (FIG. 3) and markers SNPM02708 and SNPM02400 were positioned on each side of the VIR locus. The interval contained 4 potential candidate genes that impact fruit pigmentation in other species: a gene with significant homology to both *Arabidopsis* PRODUCTION OF ANTHOCYANIN PIGMENT 1 (PAP1) and AtMYB113, and homologues of *Arabidopsis* TRANSPARENT TESTA 12 (7TI2), PURPLE ACID PHOSPHA TASE 18 (PAP18) and the BHLH gene, ILR3.

Figure 4:
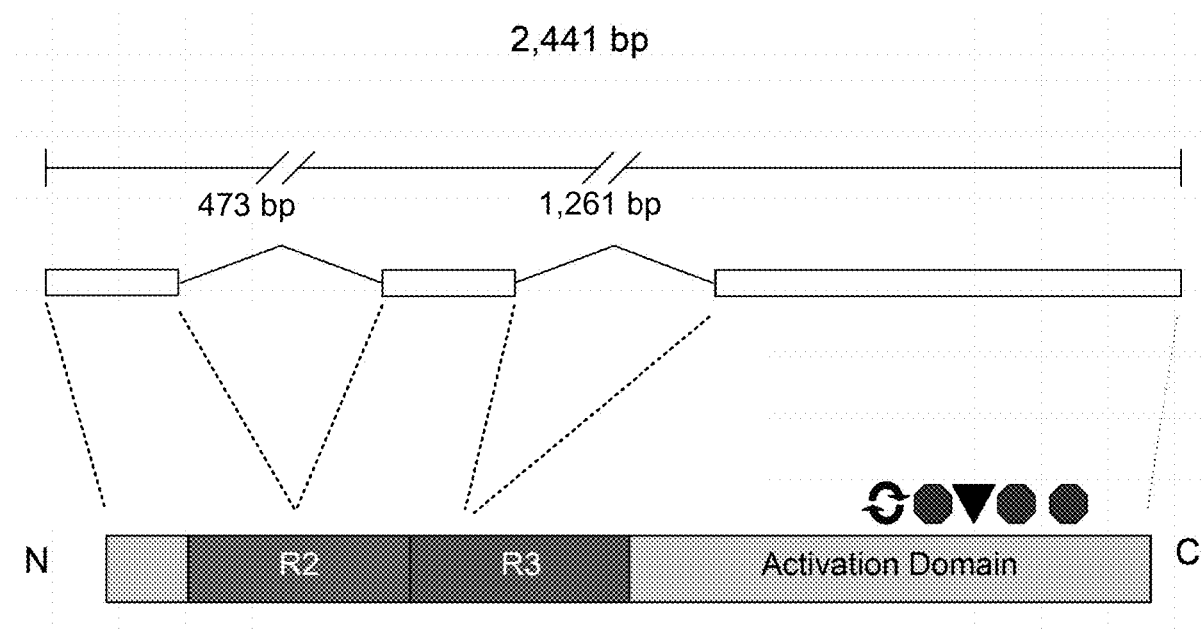
FIG. 4: Structure of the VIR gene and diagram of the five mutation events accounting for the *virescens* fruit colour phenotype. The 2,441 bp VIR gene codes for a 236 amino acid homolog of OsMYB113, which is an R2R3 class transcription factor. The R2 and R3 domains are intact in both wild type and sequenced mutants. However, the five observed mutations in sequenced *virescens* palms each caused a truncation in the activation domain of the protein. The relative locations of early stop codons (octagon), frame shift introducing deletions (triangle) and rearrangement with small duplication (arrow loop) are shown.
Figure 6:
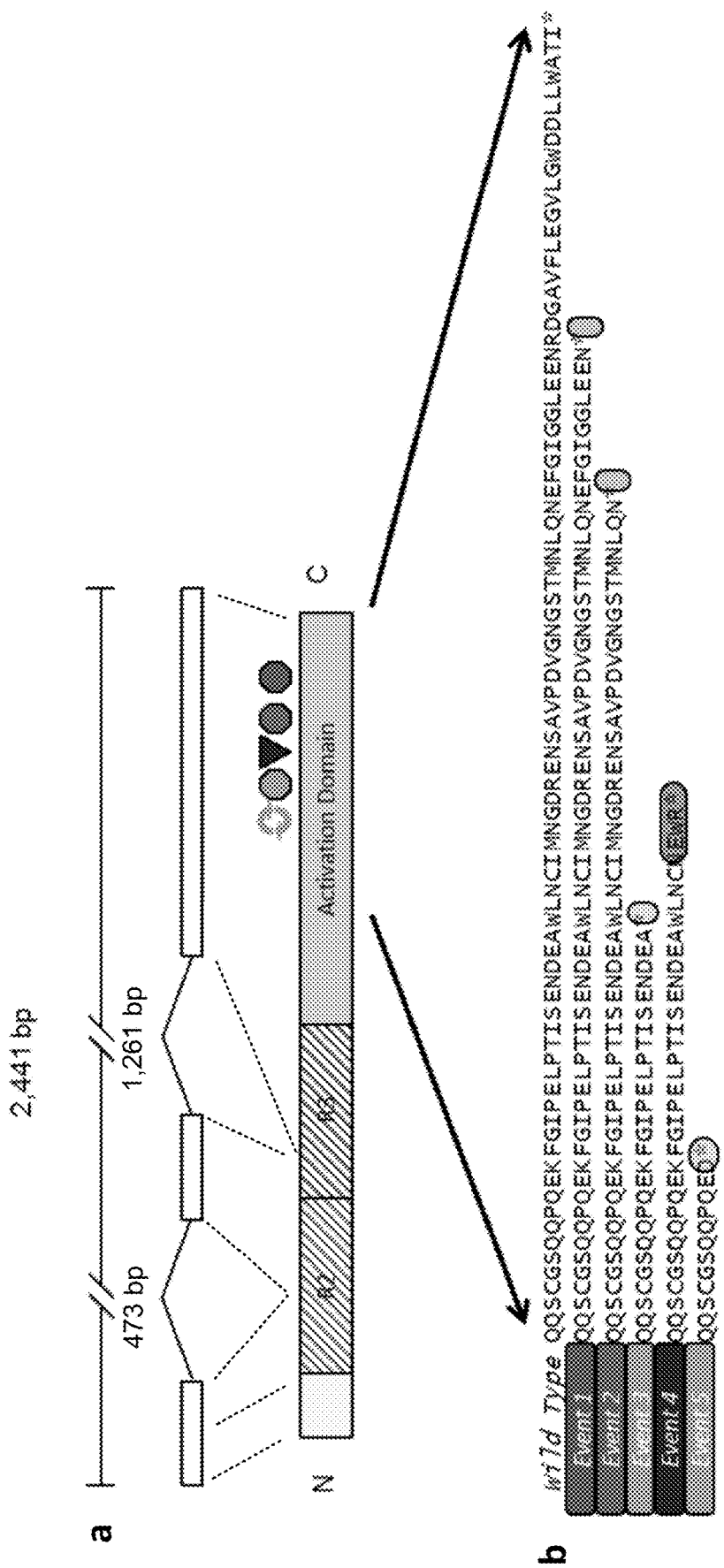
FIG. 6: Five independent VIR mutations account for *virescens* fruit exocarp colour phenotype. a, Diagram of the VIR gene. The 2.4 Kb locus (top line) includes three exons (open boxes) encoding the regions of the R2R3-MYB protein, as indicated by dashed lines. The protein (bottom diagram) includes two helix-loop-helix motifs, R2 and R3, followed by a transcriptional activation domain (grey box). Symbols above the activation domain represent relative positions of the Event 1-5 mutations. Symbol colours indicate the specific mutational event as shown in panel b. b, Protein sequence of the carboxy-terminal region of VIR encoded by wild-type (SEQ ID NO:26) and mutant VIR alleles. Nonsense point mutations (Events 1-3; SEQ ID) NOS:27-29), a two bp frameshift deletion (Event 4: SEQ ID NO:30) and a rearrangement (Event 5; SEQ ID NO:31) each results in premature termination of the activation domain at the indicated amino acid position. DNA sequences and details of the Event 5 rearrangement are provided in FIGS. 4 and 5.

Identification of the VIR Gene and Mutations Responsible for *Virescens* Fruit Colour To extend beyond the *E. guineensis* reference genome sequence, we queried genome sequence assemblies of 12 independent T128 progeny palms (5 *nigrescens* and 7 *virescens*) derived from 20-fold raw sequence coverage (HISEQ2000) per genome. Contigs from each assembly were mapped to the scaffolds which had been linked to genetic markers in the *virescens* genetic interval. In addition, the candidate genes above were each amplified by PCR, including exons and introns, and sequenced (AB13730). The entire open reading frame of the gene homologous to PAP1 and AtMYB113 was intact in all 5 *nigrescens* palms. However, all 7 *virescens* palms were either heterozygous (n=4) or homozygous (n=3) for an A-to-T nonsense mutation in exon 3 of the identified candidate VIR gene (FIGS. 4 and 5). The exon 3 mutation results in a predicted truncation of the 21 carboxy-terminal amino acids within the transcriptional activation domain of the R2R3-MYB transcription factor (FIG. 6).

Subsequently, the entirety of the gene was amplified and sequenced in 208 plants from the T128 cross (48 *nigrescens* and 160 *virescens*). In all, 158 plants were either heterozygous (n=99) or homozygous (n=0.59) for the nonsense mutation in exon 3, and 50 plants were homozygous wild-type, for an overall concordance of this nonsense mutation (Event 1) with fruit colour phenotype of 99% (Table 6). It is noted that a 1% discordance rate is well within the norms of phenotyping accuracy of breeding populations (Singh, R. et al. *Nature* 500, 340-344 (2013)). Although SNPs were identified in the other three candidate genes, the polymorphisms observed were not consistent with a functional mechanism affecting fruit colour phenotype of the twelve plants, and independent mutant alleles (see below) were not identified.

TABLE 6

Summary of VIR genotypes

| | Phenotype | | | Genotype | | | | | | Gen/Phen |
|---|---|---|---|---|---|---|---|---|---|---|
| | Nig[a] | Vir[b] | Total | Nig[c] | Event 1 | Event 2 | Event 3 | Event 4 | Event 5 | Concordance[d] |
| Mapping population | | | | | | | | | | |
| T128 | 48 | 160 | 208 | 50 | 158 | — | — | — | — | 99.0% |
| Breeding Populations | | | | | | | | | | |
| DT35 | 11 | 11 | 22 | 11 | 11 | — | — | — | — | 100.0% |
| DT38 | 8 | 12 | 20 | 8 | 12 | — | — | — | — | 100.0% |
| DP454 | 9 | 12 | 21 | 9 | 12 | — | — | — | — | 100.0% |
| TT108 | 6 | 6 | 12 | 6 | 6 | — | — | — | — | 100.0% |
| AVROS | 43 | — | 43 | 43 | — | — | — | — | — | 100.0% |
| MPOB PK575 | 10 | 11 | 21 | 10 | 11 | — | — | — | — | 100.0% |
| Total | 87 | 52 | 139 | 87 | 52 | 0 | 0 | 0 | 0 | 100.0% |
| Germplasm Collections | | | | | | | | | | |
| Angola | 261 | 48 | 309 | 262 | — | 45 | 1 | 1 | — | 99.7% |
| Madagascar | 27 | — | 27 | 27 | — | — | — | — | — | 100.0% |
| Tanzania | 47 | 12 | 59 | 45 | — | 14 | — | — | — | 96.6% |
| Ghana | 8 | 15 | 23 | 8 | 3 | 4 | 8 | — | — | 100.0% |
| Congo | 3 | 7 | 10 | 2 | — | 5 | 1 | 2 | — | 90.0% |
| Cameroon | 5 | 3 | 8 | 5 | — | — | — | — | 3 | 100.0% |
| Nigeria | 2 | 2 | 4 | 2 | 2 | — | — | — | — | 100.0% |
| Total | 353 | 87 | 440 | 351 | 5 | 68 | 10 | 3 | 3 | 99.1% |
| Overall Total | 488 | 299 | 787 | 488 | 215 | 68 | 10 | 3 | 3 | 99.2% |

[a]Nigrescens fruit exocarp colour phenotype
[b]Virescens fruit exocarp colour phenotype
[c]Wild-type (nigrescens) genotype
[d]Genotype/Phenotype Concordance calculated as ((Number of virescens phenotyped plants genotyped as either heterozygous or homozygous for Event 1, 2, 3, 4, or 5) + (Number of nigrescens phenotyped plants genotyped as wild-type)) divided by the total number of plants sequenced.

To further support the discovery of the VIR gene, we sequenced the entire gene in 6 independent breeding populations, as well as samples from germplasm collections (Table 6). The breeding populations included 139 plants where the fruit colour phenotype was known (DT35, DT38, DP454, TT108, MPOBPK575 and a collection of palms from the AVROS background). In addition, 440 plants from Angola, Madagascar, Tanzania, Ghana, Congo, Cameroon and Nigeria were analyzed. In the breeding populations, all 52 virescens, but none of the 87 nigrescens plants were found to be either heterozygous or homozygous for the Event 1 nonsense mutation in exon 3 (Table 6).

Figure 7:
FIG. 7: Geographic sources of VIR mutant alleles. Palms were genotyped by sequencing to identify homozygosity or heterozygosity for each of the five identified VIR mutations (Events 1-5). The location(s) of palms harbouring each of the mutation events in Africa is shown.

However, among the germplasm collections, the Event 1 mutation was detected in only 5 of 87 virescens plants, all of which were from either the Ghana or Nigeria collections. Instead, four independent, but closely related, mutations were identified in the other germplasm collections from sub-Saharan Africa. First, a G-to-T nonsense mutation (Event 2) was detected in exon 3, 30 base pairs (bp) 5' to Event 1 (FIGS. 4-6). This mutation results in a predicted truncation of the 31 carboxy-terminal amino acids within the transcriptional activation domain. Event 2 was heterozygous or homozygous in 68 plants from the Angola (n=45), Tanzania (n=14), Ghana (n=4) or Congo (n=5) collections (Table 6, FIG. 7). Next, a G-to-A nonsense mutation (Event 3) was detected in exon 3, 113 bp 5' to Event 1 (FIGS. 4-6). This mutation results in a predicted truncation of the 59 carboxy-terminal amino acids. The Event 3 mutation was heterozygous in 10 plants from Angola (n=1), Ghana (n=8) or Congo (n=1) (Table 6, FIG. 7). A fourth mutation (Event 4) is a two bp deletion beginning 11 bp 3' to Event 3, resulting in translation frameshift at the 55th carboxy-terminal amino acid (FIGS. 4-6), and was heterozygous in 3 plants from Angola and Congo (Table 6, FIG. 7).

Finally, a heterozygous rearrangement (Event 5) resulting in a translational frameshift and premature truncation was detected in 3 of 3 virescens plants from Cameroon (Table 6, FIGS. 4-7). The mutation is a 195 bp deletion with a 21 bp duplication which results in the truncation of 75 carboxy-terminal amino acids and a single amino acid conversion before reading a new stop codon. Considering all five single gene mutations, the concordance between genotype and fruit colour is 99.2% (Table 6).

The identification of 5 independent genetic mutations, each resulting in remarkably similar premature truncation within the activation domain, provides strong evidence for the identification of the VIR gene. C-terminal truncations of related genes in the R2R3-Myb family, most notably the maize C1 gene, have similarly dominant negative allelic forms (McClintock, B. Cold Spring Harb. Symp. Quant. Biol. 16, 13-47 (1951)). Furthermore, sequence similarity searches (BLAST™) of the genome of the South American oil palm, E. oleifera (Singh, R. et al. Nature 500, 335-339 (2013)), which does not produce the deep violet coloured fruits similar to wild-type E. guineensis, do not identify an intact VIR gene.

Phylogeny, Expression and Function of VIR

The R2R3-MYB family includes more than 100 genes in Arabidopsis (Kranz, H. D. et al. Plant J. 16, 263-276 (1998); Romero, I. et al. Plant J. 14, 273-284 (1998)) and more than 80 genes in maize (Rabinowicz, P. D. et al. Genetics 153, 427-444 (1999)). The family includes two sets of imperfect repeats (R2 and R3), each including three alpha-helices forming a helix-turn-helix motif (Du, H. et al. Biochemistry 74, 1-1 (2009)). The R2R3 proteins are members of regulatory networks controlling development, metabolism and responses to biotic and abiotic stresses (Dubos, C. et al.

Figure 8:
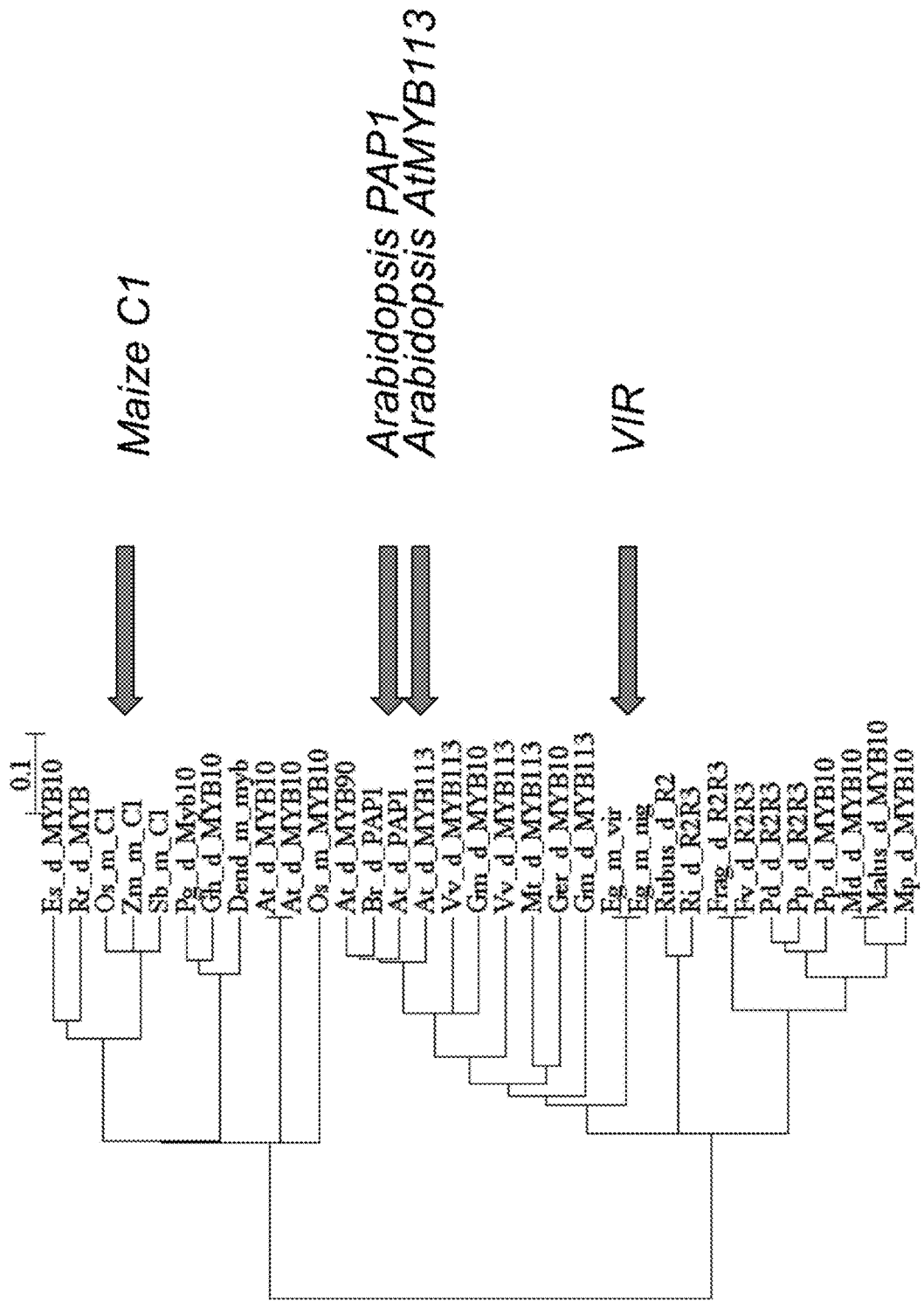
FIG. 8: Phylogenetic analysis of VIR and various R2R3-MYB family members. Species abbreviations are *Arabidopsis thaliana* (At), *Zea mays* (Zm), *Sorghum bicolor* (Sb), *Oryza saliva* (Os), *Epimedium sagiatum* (Es), *Rosa rugosa* (Rr), *Rubus idaeus* (Ri), *Rubus* hybrid (*Rubus*), *Prunus persica* (Pp). *Prunus dulcis* (Pd). *Malus×domestica* (Md), *Malus* hybrid (*Malus*), *Malus pumila* (Mp), *Fragaria×ananassa* (Frag), *Fragaria vesca* (Fv), *Gerbera hybrida* (Ger), *Medicago truncatula* (Mt), *Vitis vinifera* (Vv), *Brassica rapa* (Br), *Glycine max* (Gm), *Elaeis guineensis* (Eg), *Picea glauca* (Pg), *Dendrobium* sp. XMW-2002-10 (Dend), and *Gossypium hirsutum* (Gh). Monocots and dicots are designated with "in" and "d" respectively.
Figure 9:
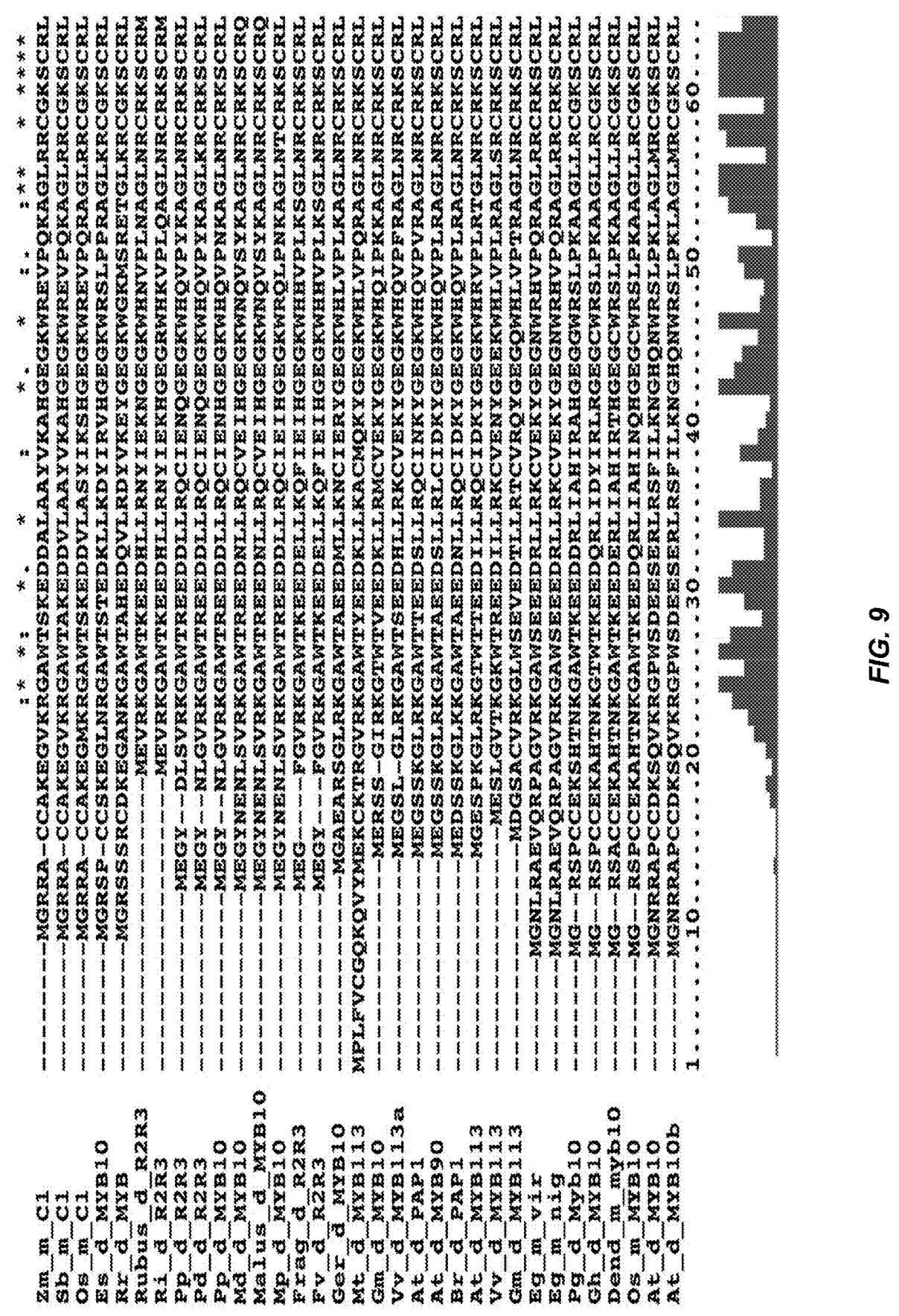
Figure 9:
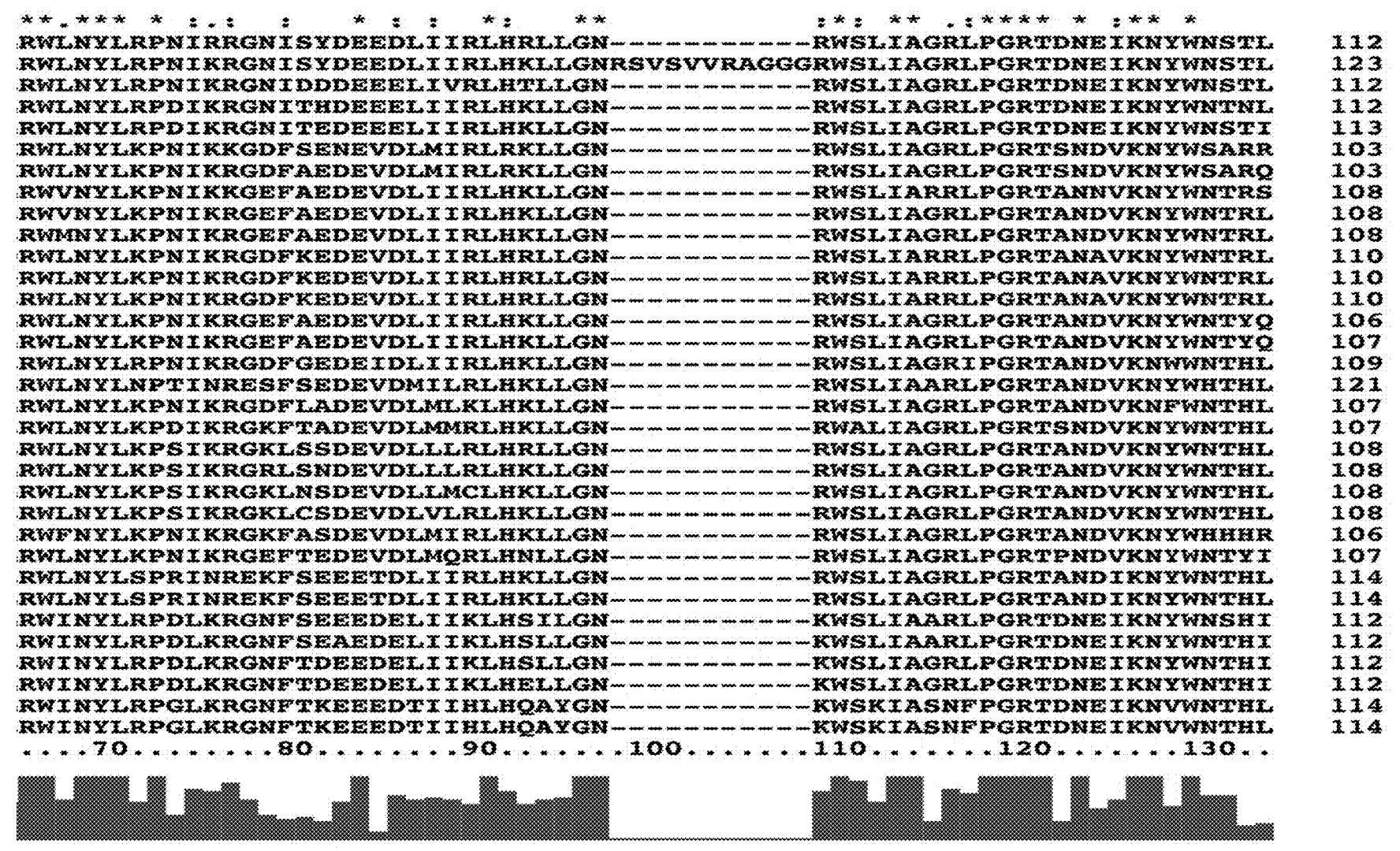

Trends Plant Sci. 15, 573-581 (2010)). We performed a phylogenetic analysis of the R2R3-MYB domain of VIR relative to other family members from various plant species, and the resulting phylogenetic tree suggests that it is related to MYB113/PAP1 (FIGS. 8, and 9). PAP1 and AtMYBI 13 belong to the phylogenetic branch of R2R3 proteins controlling accumulation of anthocyanins by regulation of biosynthetic gene expression (Borevitz, J. O. et al. *The Plant Cell* 12, 2383-2394 (2000); Gonzales, A. et al. *Plant. J.* 53, 814-827 (2008)). Overexpression of *Arabidopsis* PAP1 results in intense purple pigmentation in many vegetative organs throughout development, and ectopic expression of *Arabidopsis* PAP1 in tobacco results in purple pigmented plants (Borevitz, J. O. et al. *The Plant Cell* 12, 2383-2394 (2000)). Overexpression of AtMYB113 in *Arabidopsis* results in elevated pigment production, and down-regulation of AIMYB113, AtMYB114, PAP1 and PAP2 results in anthocyanin deficiency (Gonzales, A. et al. *Plant J.* 53, 814-827 (2008)). Furthermore, similar to the VIR mutations reported here, frameshift mutations in the carboxy-terminal region of C1 generates a dominant-negative inhibitory protein in maize, C1-1 (Goff, S. A. et al. *Genes Dev.* 5, 298-309 (1991)). Ectopic expression of another allele of maize C1-I that lacks only four carboxy-terminal amino acids (c1-1-2K1) results in severe reduction of pigmentation in tobacco (Chen, B. et al. *Mol. Biotechnol.* 26, 187-192 (2004)). Finally, overexpression of *Arabidopsis* Mv1114 lacking the transactivation domain results in dominant anthocyanin deficiency (Gonzales, A. et al. Plant J. 53, 814-827 (2008)).

Figure 10A:
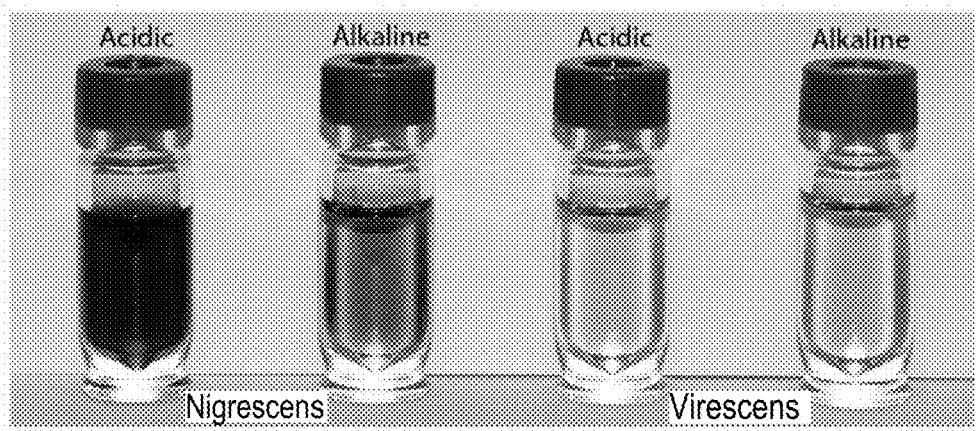
FIG. 10: Anthocyanin profiles in the *virescens* and *nigrescens* exocarp. a, Exocarp extracts in acidic and alkaline conditions. The *nigrescens* extract was brilliant red in acid and turned green under alkaline conditions. The *virescens* extract, however, was light orange and did not change under alkaline conditions. b, UV-VIS spectrophotometric profile of the extracts at pH 1. *Nigrescens* exhibited a maximum absorbance peak at about 520 nm. This peak was not observed in *virescens*. Anthocyanins are known to absorb strongly around this wavelength. c, HPLC profile at 520 nm. The *nigrescens* extract had at least 3 major anthocyanin peaks at 520 nm, which were absent in *virescens*. d, Transcriptome analyses of *nigrescens* and *virescens* whole fruit at 8 WAA. The average expression measured as $\log_{10}$ fragments per thousand mapped (FPKM) for all transcript reads matching each gene in the anthocyanin phenylpropanoid pathway was calculated, and the values obtained from *virescens* fruits was subtracted from those obtained from *nigrescens* fruits. Gene groups are plotted in pathway order, suggesting that *virescens* fruits display impaired Myb/bHLH/WD-repeat regulated gene expression beginning at the CHS step of the pathway.
Figure 10B:
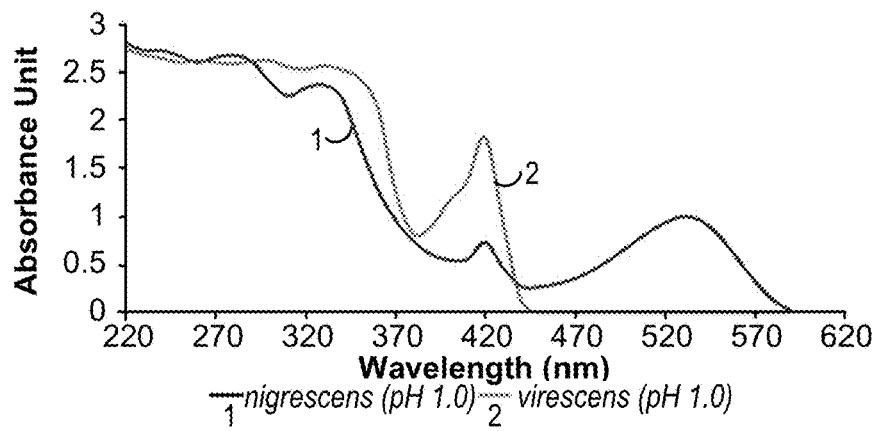
Figure 10C:
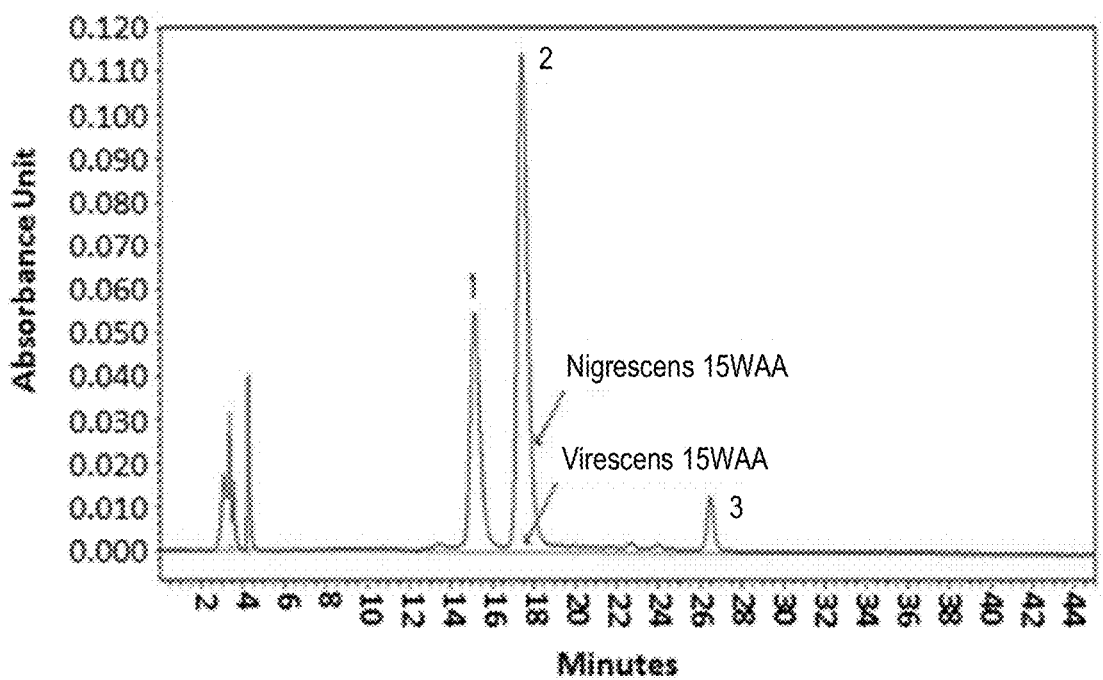

In order to examine anthocyanin deficiency in *virescens* fruits, we performed a combination of metabolic and gene expression analyses. Spectrophotometric and chromatographic (HPLC) analyses of acidified methanol extracts of exocarp confirmed the presence of anthocyanins in *nigrescens*, but absence in *virescens* fruit (FIG. 10*a-c*). Gene expression in *nigrescens* and *virescens* whole fruits at 8 weeks after anthesis (WAA) was analyzed by transcriptome sequencing (Table 7). The oil palm fruit typically exhibits biphasic growth with an initial growth spurt between approximately 4 to 9 WAA. Further, significant biochemical changes are observed starting at 8 WAA and up to 10 WAA during the transition phase between a metabolic sink and a storage sink (Kok, S. Y. et al. *J. Plant Res.* 126, 539-547 (2013)). Therefore, 8 WAA was chosen to examine expression of anthocyanin biosynthetic genes, avoiding later stages when expression of other mesocarp genes occurs that share the phenylpropanoid pathway, such as those involved in polyphenol biosynthesis.

TABLE 7

Samples used for transcriptome sequencing

| Plant ID | Fruit Colour Phenotype | Stage | Tissue Type |
| --- | --- | --- | --- |
| 0.482/6 | Nigrescens | 8WAA | Whole Fruit |
| 0.482/6 | Nigrescens | 8WAA | Whole Fruit |
| 0.482/6 | Nigrescens | 8WAA | Whole Fruit |
| 0.482/8 | Nigrescens | 8WAA | Whole Fruit |
| 0.482/8 | Nigrescens | 8WAA | Whole Fruit |
| 0.482/8 | Nigrescens | 8WAA | Whole Fruit |
| 0.481/350 | Virescens | 8WAA | Whole Fruit |
| 0.481/350 | Virescens | 8WAA | Whole Fruit |
| 0.481/350 | Virescens | 8WAA | Whole Fruit |

Figure 10D:
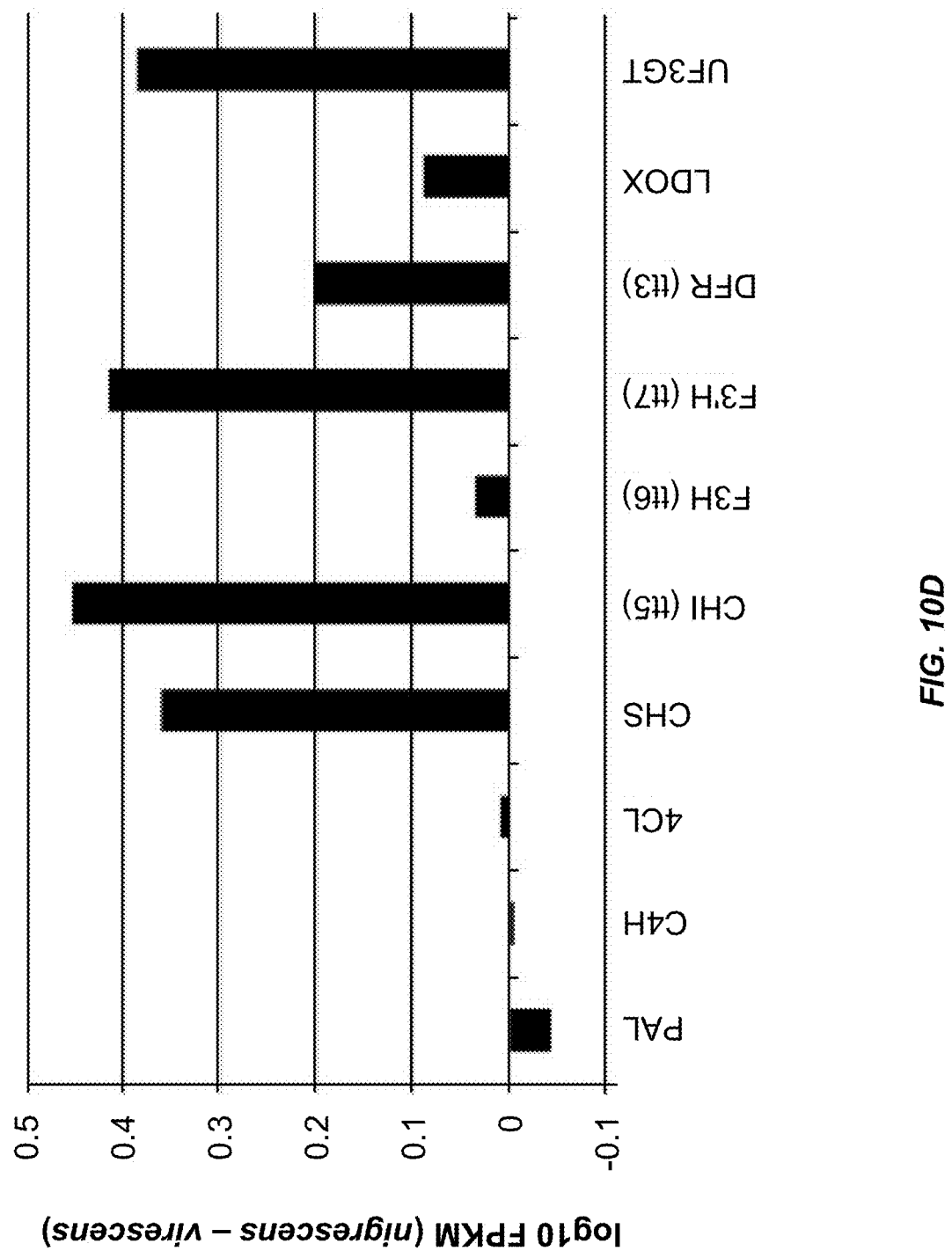

Transcriptome reads with substantial sequence similarity to each biosynthetic gene in the *Arabidopsis* anthocyanin phenylpropanoid pathway were identified (Tables 7 and 8). Flavonoid enzymes can be divided into "early" and "late" groups that regulate distinct temporal stages of the pathway (Pelletier, M. K., et al. Plant Physiol. 113, 1437-1445 (1997)). However, the point in the pathway at which the early and late stages divide differs among various plant species. For example, in *Arabidopsis* seedlings, the late genes initiate at the F3'H step, with downstream genes being regulated by Myb/bHLH/WD-repeat proteins (Gonzales. A. et al. Plant J. 53, 814-827 (2008)) while in maize aleurone, the early/late split occurs at CHS, farther upstream in the pathway (Taylor and Briggs, *Plant Cell* 2, 115-127 (1990)). At 8 WAA, *nigrescens* fruits display dramatically higher expression of CHS and all later pathway genes (FIG. 10*d*). These results suggest that the truncating VIR mutations result in dominant inhibition of Myb-regulated target genes beginning at CHS and extending throughout the anthocyanin biosynthetic pathway, implying a late gene group similar to that in the maize aleurone.

TABLE 8

Transcriptome sequence analysis of *nigrescens* vs. *virescens* fruits

| Gene name[a] | Number of genes included[b] | nigrescens[c] | virescens[c] | Difference (nigrescens-virescens)[d] |
| --- | --- | --- | --- | --- |
| Vir | 1 | 0.737 | 0.138 | 0.599 |
| PAL | 10 | 0.217 | 0.261 | −0.044 |
| C4H | 26 | 0.956 | 0.961 | −0.005 |
| 4CL | 14 | 0.396 | 0.387 | 0.009 |
| CHS | 4 | −1.011 | −1.372 | 0.361 |
| CHI TT5 | 24 | 1.977 | 1.523 | 0.454 |
| F3H TT6 | 13 | 0.721 | 0.685 | 0.036 |
| DFR TT3 | 13 | 0.737 | 0.534 | 0.204 |
| LDOX | 18 | 0.590 | 0.501 | 0.089 |
| UF3GT | 57 | −0.391 | −0.778 | 0.387 |

[a]Biosynthetic genes in the *Arabidopsis* anthocyanin phenylpropanoid pathway
[b]Indicates the number of *E. guineensis* gene models that were grouped into each pathway gene group.
[c]Mean of $\log_{10}$ expression measured in fragments per thousand mapped reads (FPKM) as calculated by CUFFLINKS. To establish a limit of detection, a value of 0.00001 was added to each FPKM value.
[d]Mean of $\log_{10}$ FPKM for *nigrescens* fruits minus that for *virescens* fruits. Positive values represent higher expression in *nigrescens*, relative to *virescens*, fruits.

Discussion

Our findings establish that the oil palm VIR gene controls fruit colour and that any one of five independent, but closely related, dominant mutations in the gene can cause the *virescens* fruit colour phenotype (FIG. 11). The discovery of the genetic basis of the *virescens* phenotype paves the way for development of genetic testing for fruit colour well before planting and for the introgression of the desirable trait into elite breeding materials. For example, the identification of the VIR gene allows differentiation of the homozygous and heterozygous forms of *virescens* palms, as early as the seedling stage, and together with the recent identification of SHELL (Singh, R. et al. *Nature* 500, 340-344 (2013)), allows breeders to develop parental (*pisifera*) lines that are homozygous for *virescens* for use in breeding programmes or for commercial seed production. All 5 alleles of VIR from equatorial Africa have C-terminal frameshifts and stop codons, and their prevalence is unprecedented. This likely reflects dominant negative inheritance (which makes novel alleles conspicuous) and cultural practices that retain the alleles for ritual purposes. The utility of these alleles will have important impacts on fruit harvesting practices, to improve oil yields and lead to improved land utilization.

SEQ ID NO:1 is the genomic interval of VIR in a *nigrescens* palm from the T-128 cross, including 182 bp 5' of the start codon, 2,445 bp comprising the introns and exons of the gene, and 713 bp 3' of the wild type stop codon.

SEQ ID NO:2 is the nucleotide coding sequence of the wild-type VIR gene from the start codon to the stop codon.

SEQ ID NO:3 is the expressed sequence of the VIR gene in a *nigrescens* plant including predicted 5' and 3' UTR sequence.

SEQ ID NO:4 is the predicted amino acid translation of the wild-type VIR polypeptide.

SEQ ID NO:5 is the predicted amino acid translation of the VIR Event 1 mutation, which was discovered in *viriscens* palms in the T128 segregating cross.

SEQ ID NO:6 is the observed partial nucleotide coding sequence of VIR Event 1 mutation.

SEQ ID NO:7 is the reconstructed complete coding sequence of VIR Event 1 mutation.

SEQ ID NO:8 is the amino acid translation of the VIR Event 2 mutation.

SEQ ID NO:9 is the reconstructed complete coding sequence of VIR Event 2 mutation.

SEQ ID NO:10 is the amino acid translation of the VIR Event 3 mutation.

SEQ ID NO:11 is the reconstructed complete coding sequence of VIR Event 3 mutation.

SEQ ID NO:12 is the amino acid translation of the VIR Event 4 mutation.

SEQ ID NO:13 is the reconstructed complete coding sequence of VIR Event 4 mutation.

SEQ ID NO:14 is the amino acid translation of the VIR Event 5 mutation.

SEQ ID NO:15 is the reconstructed complete coding sequence of VIR Event 5 mutation.

SEQ ID NO:16 is the genomic interval sequence of the VIR gene in a *viriscens* plant.

SEQ ID NO:17 is an approximately 2 megabase pair long genomic interval from the reference genome sequence of a congo derived *pisifera* palm around the VIR gene where the first base of the start codon is at position 1,000,001, and there is roughly a megabase 5' and 3' flanking the gene.

Example 2

Differential Detection of Wild-type and Event 2 VIR Alleles

A subset of VIR exon 3 including the Event 2 point mutation is shown in FIG. 12a. The G-to-T point mutation is indicated by the lower case "t" in the figure panel. The Event 2 nonsense mutation creates an AseI restriction enzyme recognition sequence (boxed bases in FIG. 12a). As shown in the figure, PCR primers (denoted by arrows) can be designed to amplify the surrounding sequence so that the amplicon includes only one potential AseI site, and this site is only present on alleles including the vir$^{Event2}$ nonsense mutation. Using the primers suggested in the figure, PCR amplification results in a 340 bp amplicon. As shown in the prophetic example in FIG. 12b, amplicons can be split into two portions: the first portion is mock-treated without restriction enzyme (NE) and the second portion is digested with AseI. Following gel electrophoresis, all NE portions will have a single 340 bp band. Amplicons derived from VIR/VIR genomic DNA will have a single 340 bp band in both the NE and the AseI lanes. Amplicons derived from VIR/vir$^{Event2}$ genomic DINA will have a single 340 bp band in the NE lane and three bands (340, 189 and 151 bp) in the AseI lane: 340 bp derived from the VIR allele and 189 and 151 bp obtained by AseI digestion of the vir$^{Event2}$ allele. Amplicons derived from vir$^{Event2}$/vir$^{Event2}$ genomic DNA will have a single 340 bp band in the NE lane and two bands (189 and 151 bp) in the AseI lane. Therefore, this type of assay can be used to determine the VIR genotype of a DINA or RNA (via reverse-transcriptase PCR) sample and detect the heterozygous or homozygous presence of the vir$^{Event2}$ mutation.

Figure 13:
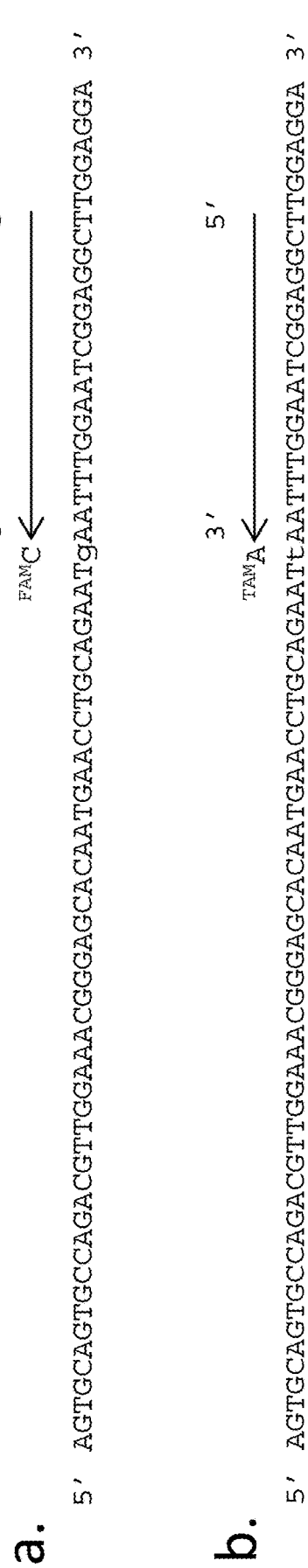
FIG. 13: Single nucleotide primer extension-based assay for genotyping the vir$^{Event2}$ allele. a, Depicts an exemplary primer (SEQ ID NO:72) and primer extension product (SEQ ID NO:73) for detecting the wild-type VIR allele (template=SEQ ID NO:71). The primer extension product contains a 3' cytosine nucleotide linked to a detectable fluorescein derivative, denoted as $^{FAM}$C. b, Depicts an exemplary primer (SEQ ID NO:72) and primer extension product (SEQ ID NO:75) for detecting the vir$^{Event2}$ allele (template=SEQ ID NO:74). The primer extension product contains a 3' adenine nucleotide linked to a detectable rhodamine derivative, denoted as $^{TAM}$A (TAMRA). Thus plants containing a a VIR/VIR, VIR/vir$^{Event2}$, or vir$^{Event2}$/vir$^{Event2}$ genotype can be differentially detected.

Alternatively, the Event 2 mutation can be genotyped by single nucleotide primer extension, thus not relying upon restriction enzyme recognition sequences or restriction digestion. As shown in FIG. 13, a primer can be designed so that its 3' terminal is complimentary to the nucleotide one base 3' of the polymorphic nucleotide. Single nucleotide primer extension is carried out with a mixture of dideoxyribonucleotides (ddATP, ddCTP, ddGTP, ddTTP), each labeled with a different fluorophore. For example, primer annealed to a VIR allele (G at the polymorphic position) could be extended by a single C tagged with FAM (FIG. 13a). Alternatively, primer annealed to a vir$^{Event2}$ allele (T at the polymorphic position) could be extended by a single A tagged with TAM (TAMRA) (FIG. 13b). Therefore, this type of assay can be used to determine the VIR genotype of a DNA or RNA (via reverse-transcriptase PCR) sample and detect the heterozygous or homozygous presence of the vir$^{Event2}$ mutation.

Example 3

Differential Detection of Wild-Type and Event 3 VIR Alleles

Figure 14:
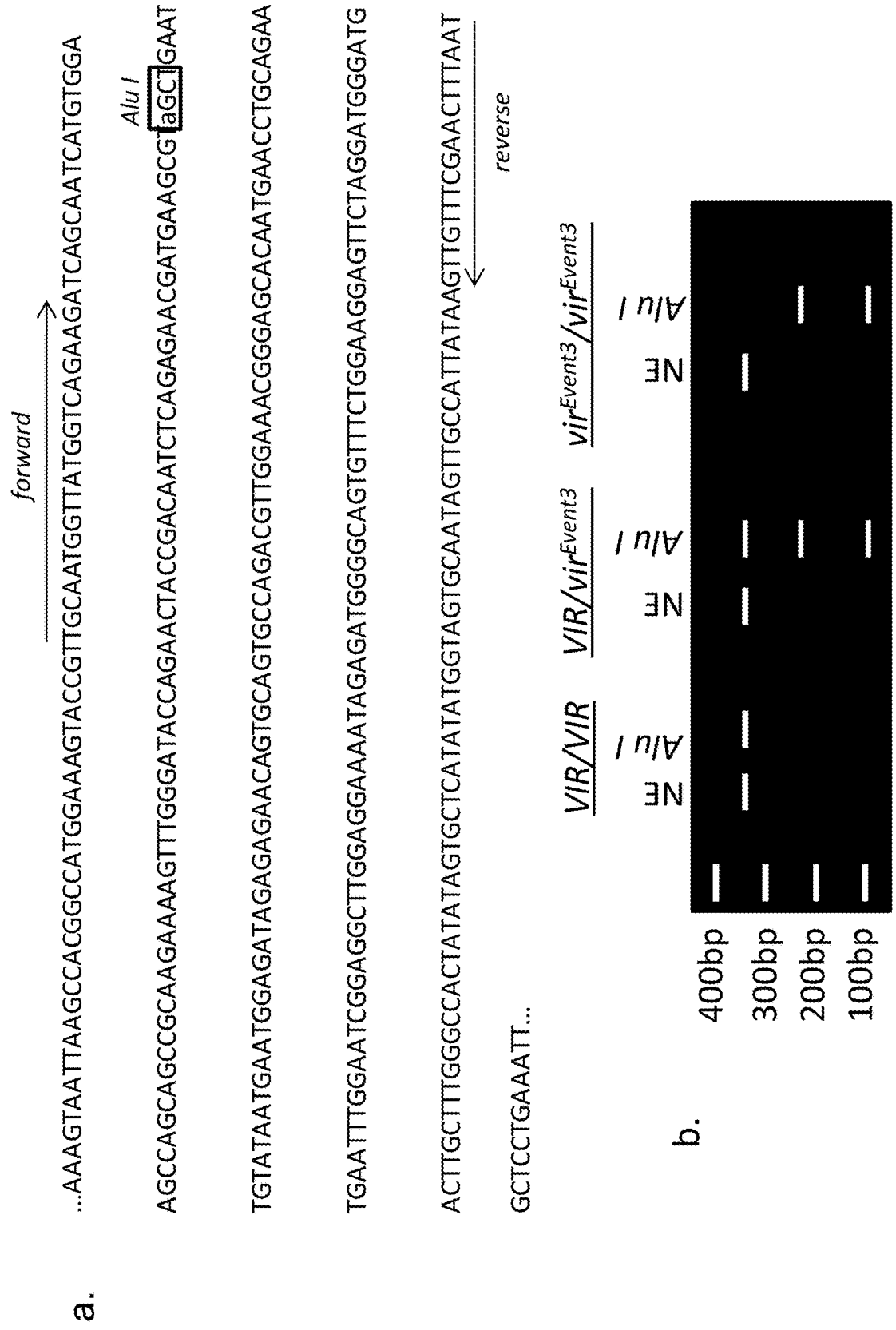
FIG. 14: Restriction enzyme-based assay for genotyping the vir$^{Event3}$ allele, a, Depicts the AluI cleavage site present in the vir$^{Event3}$ allele (SEQ ID NO:76) and binding sites for forward (SEQ ID NO:77) and reverse (SEQ ID NO:78) amplification primers. b, Depicts the results from amplifying the region flanked by the forward and reverse primers denoted in a to produce an amplicon, digesting a portion of the amplicon with AluI, and separating both the digested portion and an undigested portion by gel electrophoresis to differentially detect plants containing a VIR/VIR, VIR/vir$^{Event3}$, or vir$^{Event3}$/vir$^{Event3}$ genotype.

A subset of VIR exon 3 including the Event 3 point mutation is shown in FIG. 14a. The G-to-A point mutation is indicated by the lower case "a" in the figure panel. The Event 3 nonsense mutation creates an AluI restriction enzyme recognition sequence (boxed bases in FIG. 14a). As shown in the figure. PCR primers (denoted by arrows) can be designed to amplify the surrounding sequence so that the amplicon includes only one potential AluI site, and this site is only present on alleles including the vir$^{Event3}$ nonsense mutation. Using the primers suggested in the figure, PCR amplification results in a 340 bp amplicon. As shown in the prophetic example in FIG. 14b, amplicons can be split into two portions: the first portion is mock-treated without restriction enzyme (NE) and the second portion is digested with AluI. Following gel electrophoresis, all NE portions will have a single 340 bp band. Amplicons derived from VIR/VIR genomic DNA will have a single 340 bp band in both the NE and the AluI lanes. Amplicons derived from VIR/vir$^{Event3}$ genomic DNA will have a single 340 bp band in the NE lane and three bands (340, 108 and 232 bp) in the AluI lane: 340 bp derived from the VIR allele and 108 and 232 bp obtained by AluI digestion of the vir$^{Event3}$ allele. Amplicons derived from vir$^{Event3}$/vir$^{Event3}$ genomic DNA will have a single 340 bp band in the NE lane and two bands (108 and 232 bp) in the AluI lane. Therefore, this type of assay can be used to determine the VIR genotype of a DNA or RNA (via reverse-transcriptase PCR) sample and detect the heterozygous or homozygous presence of the vir$^{Event3}$ mutation.

Alternatively, the Event 3 mutation can be genotyped by single nucleotide primer extension, thus not relying upon restriction enzyme recognition sequences or restriction digestion. As shown in FIG. 15, a primer can be designed so that its 3' terminal is complimentary to the nucleotide one base 5' of the polymorphic nucleotide. Single nucleotide primer extension is carried out with a mixture of dideoxyribonucleotides (ddATrP, ddCTP, ddGTP, ddTTP), each labeled with a different fluorophore. For example, primer annealed to a VIR allele (G at the polymorphic position) could be extended by a single C tagged with FAM (FIG. 15a). Alternatively, primer annealed to a vir$^{Event3}$ allele (A at the polymorphic position) could be extended by a single T tagged with TAM (TAMRA) (FIG. 15b). Therefore, this type of assay can be used to determine the VIR genotype of a DNA or RNA (via reverse-transcriptase PCR) sample and detect the heterozygous or homozygous presence of the vir$^{Event3}$ mutation.

Example 4

Differential Detection of Wild-Type and Event 5 VIR Alleles

Figure 12:
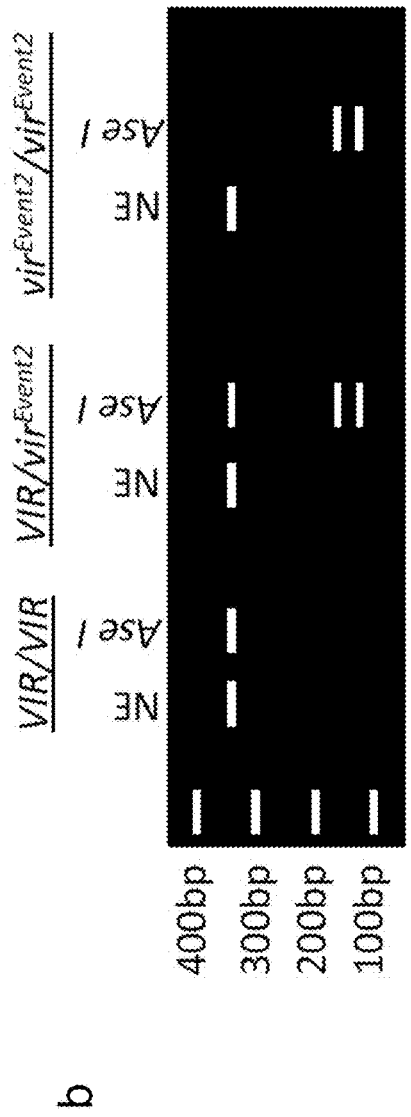
FIG. 12: Restriction enzyme-based assay for genotyping the vir$^{Event2}$ allele. a, Depicts the AseI cleavage site present in the vir$^{Event2}$ allele (SEQ ID NO:68) and binding sites for forward (SEQ ID NO:69) and reverse (SEQ ID NO:70) amplification primers. b, Depicts the results from amplifying the region flanked by the forward and reverse primers denoted in a to produce an amplicon, digesting a portion of the amplicon with AseI, and separating both the digested portion and an undigested portion by gel electrophoresis to differentially detect plants containing a VIR/VIR, VIR/vir$^{Event2}$, or vir$^{Event2}$/vir$^{Event2}$ genotype.

A subset of VIR exon 3 including the Event 5 rearrangement mutation is shown in FIG. 16a. The rearrangement creates a unique DNA sequence beginning at the vertical arrow in FIG. 16a. The same forward primer as shown in FIG. 12 can be used in combination with a reverse primer unique to the Event 5 allele to generate a 137 bp amplicon only from genomic DNA containing at least one Event 5 allele. A third reverse primer, as shown in FIG. 12, in combination with the common forward primer would generate a 340 bp amplicon only from genomic DNA containing the VIR allele. The Event 5 mutation introduces a unique AseI restriction enzyme site in the 137 bp amplicon that is not present in the 340 bp VIR amplicon. As shown in the prophetic example in FIG. 16b, amplicons can be split into two portions: the first portion is mock-treated without restriction enzyme (NE) and the second portion is digested with AseI. Following gel electrophoresis, amplicons derived from VIR/VIR genomic DNA will have a single 340 bp band in both the NE and the AseI lanes. Amplicons derived from VIR/vir$^{Event5}$ genomic DNA will have a 340 bp band and a 137 bp band in the NE lane and three bands (340, 78 and 59 bp) in the AseI lane: 340 bp derived from the VIR allele and 78 and 59 bp obtained by AseI digestion of the vir$^{Event5}$ allele. Amplicons derived from vir$^{Event5}$/vir$^{Event5}$ genomic DNA will have a single 137 bp band in the NE lane and two bands (78 and 59 bp) in the AseI lane. Therefore, this type of assay can be used to determine the VIR genotype of a DNA or RNA (via reverse-transcriptase PCR) sample and detect the heterozygous or homozygous presence of the vir$^{Event5}$ mutation.

Figure 17:
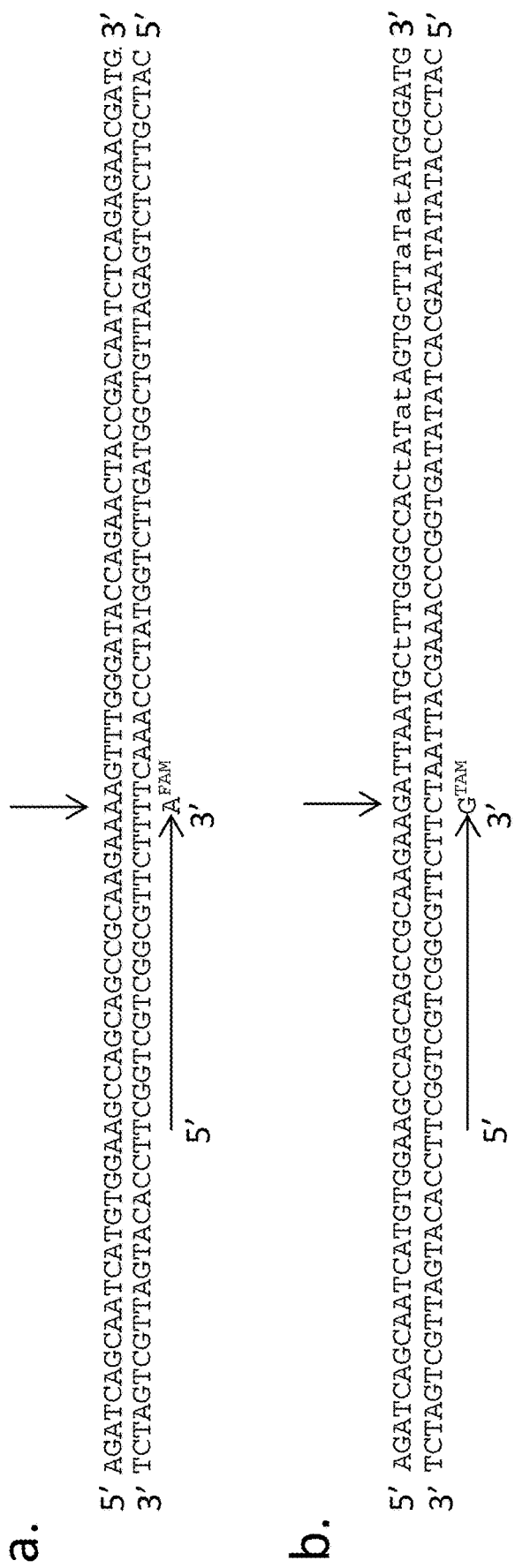
FIG. 17: Single nucleotide primer extension-based assay for genotyping the vir$^{Event5}$ allele. a, Depicts an exemplary primer (SEQ ID NO:89) and primer extension product (SEQ ID NO:90) for detecting the wild-type VIR allele (template=SEQ ID NO:87; complement=SEQ ID NO:88). The primer extension product contains a 3' thymine nucleotide linked to a detectable fluorescein derivative, denoted as A$^{FAM}$ b, Depicts an exemplary primer (SEQ ID NO:89) and primer extension product (SEQ ID NO:90) for detecting the vir$^{Event5}$ allele (template=SEQ ID NO:91; complement=SEQ ID NO:92). The primer extension product contains a 3' cytosine nucleotide linked to a detectable rhodamine derivative, denoted as G$^{TAM}$ (TAMRA). Thus plants containing a VIR/VIR, VIR/vir$^{Event5}$, or vir$^{Event5}$/vir$^{Event5}$ genotype can be differentially detected.

Alternatively, the Event 5 mutation can be genotyped by single nucleotide primer extension, thus not relying upon restriction enzyme recognition sequences or restriction digestion. As shown in FIG. 17, the sequence of VIR (FIG. 17a) and vir$^{Event5}$ (FIG. 17b) diverge at the nucleotide denoted by the downward pointing arrow. A common primer can be designed so that its 3' terminal is complimentary to the nucleotide one base 3' of the polymorphic nucleotide and the sequence of the primer is complimentary to both VIR and vir$^{Event5}$ sequence. Single nucleotide primer extension is carried out with a mixture of dideoxyribonucleotides (ddATP, ddCTP, ddGTP, ddTTP), each labeled with a different fluorophore. For example, primer annealed to a VIR allele (T at the first diverging position on the 3' to 5' strand shown in FIG. 17a)) could be extended by a single adenine tagged with FAM (FIG. 17a). Alternatively, primer annealed to a vir$^{Event5}$ allele (C at the first diverging position on the 3' to 5' strand shown in FIG. 17b)) could be extended by a single guanine tagged with TAM (TAMRA) (FIG. 17b). Therefore, this type of assay can be used to determine the VIR genotype of a DNA or RNA (via reverse-transcriptase PCR) sample and detect the heterozygous or homozygous presence of the vir$^{Event5}$ mutation.

Example 5

Differential Detection of Wild-Type, Event 1, and Event 4 VIR Alleles

Figure 18:
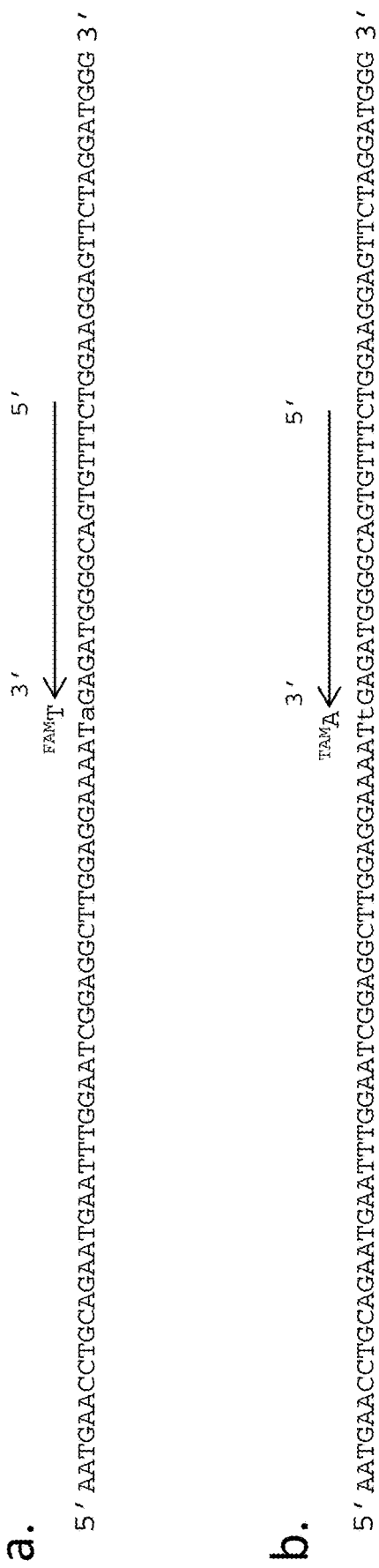
FIG. 18: Single nucleotide primer extension-based assay for genotyping the vir$^{Event1}$ allele. a, Depicts an exemplary primer (SEQ ID NO:95) and primer extension product (SEQ ID NO:96) for detecting the wild-type VIR allele (template=SEQ ID NO:94). The primer extension product contains a 3' thymine nucleotide linked to a detectable fluorescein derivative, denoted as $^{FAM}$T. b, Depicts an exemplary primer (SEQ ID NO:95) and primer extension product (SEQ ID NO:98) for detecting the vir$^{Event1}$ allele (template=SEQ ID NO:97). The primer extension product contains a 3' adenine nucleotide linked to a detectable rhodamine derivative, denoted as $^{TAM}$A (TAMRA). Thus plants containing a VIR/VIR, VIR/vir$^{Event1}$, or vir$^{Event1}$/vir$^{Event1}$ genotype can be differentially detected.

The Event 1 mutation can be genotyped by single nucleotide primer extension, thus not relying upon restriction enzyme recognition sequences or restriction digestion. As shown in FIG. 18, a primer can be designed so that its 3' terminal is complimentary to the nucleotide one base 3' of the polymorphic nucleotide. Single nucleotide primer extension is carried out with a mixture of dideoxyribonucleotides (ddATP, ddCTP, ddGTP, ddTTP), each labeled with a different fluorophore. For example, primer annealed to a VIR allele (A at the polymorphic position) could be extended by a single thymine tagged with FAM (FIG. 18a). Alternatively, primer annealed to a vir$^{Event1}$ allele (T at the polymorphic position) could be extended by a single adenine tagged with TAM (TAMRA) (FIG. 18b). Therefore, this type of assay can be used to determine the VIR genotype of a DNA or RNA (via reverse-transcriptase PCR) sample and detect the heterozygous or homozygous presence of the vir$^{Event1}$ mutation.

Figure 19:
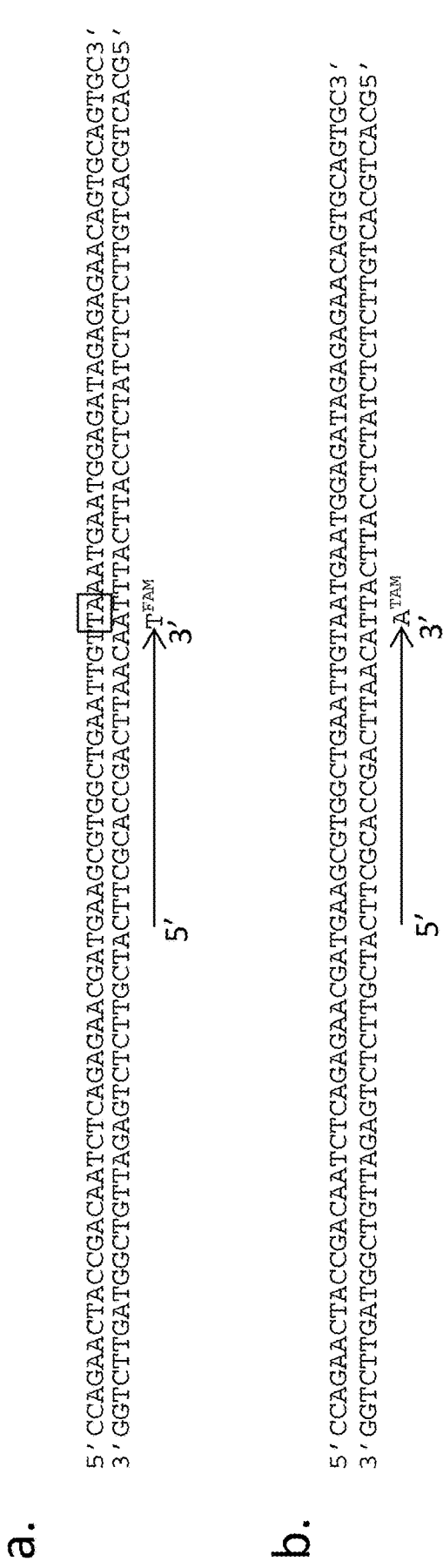
FIG. 19: Single nucleotide primer extension-based assay for genotyping the vir$^{Event4}$ allele. a, Depicts an exemplary primer (SEQ ID NO:101) and primer extension product (SEQ ID NO:102) for detecting the wild-type VIR allele (template=SEQ ID NO:99; complement=SEQ ID NO:100). The primer extension product contains a 3' adenine nucleotide linked to a detectable fluorescein derivative, denoted as T$^{FAM}$. b, Depicts an exemplary primer (SEQ ID NO:101) and primer extension product (SEQ ID NO:105) for detecting the vir$^{Event4}$ allele (template=SEQ ID NO:103; complement=SEQ ID NO:104). The primer extension product contains a 3' thymine nucleotide linked to a detectable rhodamine derivative, denoted as A$^{TAM}$ (TAMRA). Thus plants containing a VIR/VIR, VIR/vir$^{Event4}$, or vir$^{Event4}$/vir$^{Event4}$ genotype can be differentially detected.

Similarly, the Event 4 mutation can be differentially detected by single nucleotide primer extension. The vir$^{Event4}$ mutation is a deletion of 2 bases (TA) relative to VIR. These two bases are boxed in FIG. 19a. For example, primer annealed to a VIR allele one base 3' to the TA sequence deleted in vir$^{Event4}$ could be extended by a single thymine tagged with FAM (FIG. 19a). Alternatively, the same primer annealed to a vir$^{Event4}$ allele could be extended by a single adenine tagged with TAM (TAMRA) (FIG. 19b). Therefore, this type of assay can be used to determine the VIR genotype of a DNA or RNA (via reverse-transcriptase PCR) sample and detect the heterozygous or homozygous presence of the vir$^{Event4}$ mutation.

Thus, all known naturally occurring variations of the VIR locus can be detected. Consequently, the genotype of an oil palm plant at the VIR locus can be determined and the fruit color phenotype predicted. Moreover, additional naturally occurring or induced variations at the VIR locus can be detected using methods described herein or known in the art to predict the fruit color phenotype of an oil palm plant.

The term "a" or "an" is intended to mean "one or more." The term "comprise" and variations thereof such as "comprises" and "comprising," when preceding the recitation of a step or an element, are intended to mean that the addition of further steps or elements is optional and not excluded. All patents, patent applications, and other published reference materials cited in this specification are hereby incorporated herein by reference in their entirety.

SEQUENCE LISTING (105 sequences)

SEQ ID NO: 1 - DNA, 3340 bp, Elaeis guineensis
  genomic interval of VIR gene in nigrescens palm, genomic region DNA from 5' UTR, intron, exons and 3' UTR
gcaagtgcttctgcgcgcgtacgtggaaccacaagctagcccacgtatgtccccagtcttaaccgaacaaatgcgctgtatctgggtgcttataaagcatcatcgagaccatgaagtaacacacgcttacagagtatcttgcaacttgaaattgcagtgaataagctaaagttctggcctcaatgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggtaagcgattccttgcttaccgacatttgtggcaaagcaaatcgcaaaaccttttctatcctgaactgaacacacaaatgatcaaaattgctcttcaattcaacaagtatccaagcgcaagcgtatgaaggagctgttgtcttctcatcccagcacagcctaactcctgattaccttgtctcacatctttacagaataaagctgaagtctgttactcatgggtattagtaacaagagcaactctatgaaaccctgaatactttccctcttctgtactctgaactgggtgtgaagttggtaacttctcacccttttttatttcttattattcctactaaacttctgtactctttcttatatttaatgcaatgactcttgagttaggtcttccctaactcatttgcatcaaaaaaaaaaaaaaaagtggagtcttttgtcattcttgagctcattgtgcttttgtggatttgaaggcctcagaaggtgccgaaagagctgccgactacggtggttgaactatctcagccctaggatcaacagggagaaattttcggaggaagaaacagatcttatcatcaggcttcataagctcttgggcaacaggtaacaacaaactatgaagatcgttcattatatatccatttgtttatagagacctttatatttgttttgtcttgagagatgccaatagttttgcttctcttaattcatattccttacctgtaaagtgaaaaaaaaaaaaaaaaattctgtgagatcattcattatgtatgtgtttgtttttatacagctggtagctctggtggttggcacccctctcctaaggaactgttttatgggcatagaaagctcaaatcctagtattggtaaattaccatcatattactttaaccgaaaataatacttaaaaaattattgcataattttcatatgacaagttaagaaacaatattaaagttaaacggcaattacaatacaaaatgcttcatgccgctgatcaacaaaaggttcattatgtttatgtggcaaaagaggattaatttgattgaaggtgtacgctagctaacgtagtagcatgttggactgagaaaatttagtaacatgttggactgagaaaatttttgcaccactaattaccaaattctagctttcttcttatgttgggacaattaatcactaaaaaaaggataagatggtgcaaatcccatgaggaaccttgatgaagtacaaaatagagcatatttcatcatgtactgagcacaactatcttcagaatttaagctcgtgctatgtgtcttgtttgcttcatagactgtcacactcgaaccctctagataggttgacgcatgacacggccacacactccataagaaattcctagagaatgtgacatagtcaggaatcttcttgtactttgaatgtcccagtataggttccaaacaagtagactgataaatattgcatctagatttagatttaagcgcaagatctttcttttgctgaatgattttactgtattccttttgcagtagcatgtacatcaactcttaaaaatggaatctatgcacttaaacctatacccaagacgttgtgctttaggcctaaagaaaatacacgataatatcaacacattttcagtcttttcgtacaatcgtatatttgatttgttgggtttcattcttgagatcattccacttcctccgaatgcaattggcgtacgcaaccgcgggcctctagctctatttgctattttcatgcatcatgcttctcttgaatctcttgtcctccaagggaccctctctattaaatcatcacagttgaacacaaacaattcaactaatgagatctgaattcgataaatcaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttttggtcagaagatcagcaatcatgtggaagccagcagccgcaagaagagtttggcataccagagctaccgacagtctcagagaacgatgaagcgtggctgaatagtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgcttatatatggtagtgcaatagttgccattttaagttgtttcgaacattaatgctcctgaaattcccacgcaaggatttagagcttcttatcctacaaaaagacaggaaacgagaccttgaaaaaagactcggtactagaaggcatccagttattgattgcttttatacttgcaacttgaaggaagcacgctttctcaccagaatggaggtctaagcttcagtctaattagtaaatggtcatgaagcatttaaaagcactctataaacaaatcatgataatttatttccatataggcttggtcagtctcgtacccctttatttttttgaacgctctagcaggggtttccaaaatccaaccaaaaataaatggatttctccaaaactgattaattaaaaggcttgggtataccgtaggtcaacccaaaagtattggatagatgtctgatcaagatatcatcttttaaaattttttcagtaccacacgatacagtaaaaaaaataaaataaaatagtaacaatcaaaatatgtggatcagtcataaaaggactcgtctccacgagatatgcaaactctactatgaaaaaaaaaatttataaaagaagatctcatcctcaaccctcatacacacaatttctctttcatagaaagtttttcttcacaaaagctctctctcttggaagaccttcctgaatccctgaaacgatcact

SEQ ID NO: 2 - DNA, 711 bp, Elaeis guineensis
  coding sequence of wild-type VIR gene
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatag

SEQ ID NO: 3 - DNA, 5110 bp, Elaeis guineensis
  expressed sequence of VIR gene in nigrescens palm including preicted 5' and 3' UTR
  5'UTR (1)...(335): hypothetical 5'UTR
  misc_feature (336)...(1046): VIR coding sequence
  3'UTR (1047)...(5110): hypothetical 3'UTR
  modified_base (1)...(5110): n = g, a, c or t
ggtccatctccttgacaagaactataactcatcaagcatggatctccccattttcatcgccgctccgtaatatatttctacttcaagggccggcttatggtggaccaataggtgcttcatgcaaaggatcgagaagctactgaccatatccacgcaagtgcttctgcgcgcgtacgtggaaccacaagctagcccacgtatgtccccagtcttaaccgaacaaatgcgctgtatctgggtgcttataaagcatcatcgagaccatgaagtaacacacgcttacagagtatcttgcaacttgaaattgcagtgaataagctaaagttctggcctcaatgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattttaagttgtttcgaacattaatgctcctgaaattcccacgcaaggatttagagcttcttatcctacaaaaggacaggaaacgagaccttgaaaaaagactcggtactagaaggcatccagttattgattgcttttatacttgcaacttgaaggaagcacgctttctcaccagaatggaggtctaagcttcagtctaattagtaaatggtcatgaagcatttaaaagcactctataaacaaatcatgataatttatttccatataggcttggtcagtctcgtacccctttatttttttgaacgctgtggtaggggtttccaaaatccaaccaaaaataaatggatttctccaaaaatgattaatcaaaaggcctgagtatagcataggtcaactcaaaaatattggatggatgtttgatcaggacatcatcttttaagatcttttcagtaccacacaatgcagcagaaagaaagaagaaataaaacagtaacaatcaaaatacgtggatcagccacaaaagggctcgtctccacgagacatataaacttcactatgaaaaagaaattttataagaggaggtctcatcttcaaccctcgtacacataatttctatttcacggaaagttttgcctcacaaaagctctctcttagaagaccccccctgaacttctgaaacgaccgctgtccgctatccaggagccctgctctttctctctacagcgtaagacagctctctctctcttcttcacagggtgttctctggacttttcgcagtcgtacgaagttaaaacgagccaccacaccttctgttcaccgatcaggcacttttaaagggcttaaacctaattagattaggtttagatctcctaaacagacccaaacaaacttagatcaagcccggaccgttggatcgtgatcgggagctccctgggccgtccgatcacgtttcggtccacagaacagtgttgtggaccatgtgaaatgcatgaaaaatgcccacgcggtccacagatccggtcgtggaccgcctgatccacagtggactggggtacaggtccaagcgtggtgcctcgggttgcatgctgacttcaaaagcacgtattttctccgtctgagctctgtttgggtgttcttgatttcgttggactctattttttatcgtgaacctctctatgggctcaatgtgaatcgaatttcaagcgtcaaatcctaacaatctccatctcgactcaatattcggtctcctcctaactccgagagcttctggacctcttcgccccatgtcctgggacaatcgtctgcggatcatggatggacaaacatgagagtcgagcgaggccactcgatctcattttcgtcgtatgctgtgctcctcctgacctgagacctgctcggggcatcatcctgtggcaataggaatctcaccttgcgacgtcgcctctcatcctcctagtctcctatctcgtgcccgatccacctctacctggagctccacctcactctgagctccacctggctcctgaaactccacctcacactgggctccccgtcaggtaataatatcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatcggatctctcccaatctcctcactgcaccatcatgtgtcctccagctgaccatcccaatgcttttgatctcacagctcgattcatccgacagatatacagtaccctcactatttttcagggagtcaaactgctcctctctgcaacatacatgatgggtgcatgcagaatctaatatccactactagaaagaagtagatacctcgtcagatatctctaggacatttccatctgaatcactgctggccgtcgccacagcagccatcatccaatttttgagttaagggcaatctctggctagatgtcccaactcctcacactggtaacacctggctttgttcaagtccctcttggagttggactgccctcgtctcgatctcttgtcgctccgtctacctcctcctgctcctccagaagccatcaaagctgagctactgccacctgagctcgaagctgggttcttcctcccgagaatatagttctggagtatcatcatagtgactttatctatcttgatggtgttcttccccactagtagagcagtcgtcaaggactcgtacaaaggtggaagcgatgctggcaaaaccagtgccctggtcttctcttcaatattctcatcaacgctgaggaggtcagtgaggatcttctgaaagtggttgagatgctcctgctcgctctatcccttagccatctgcagctggtaaaactgtctctagaggaaaagagtgttggtgagagacttcgccatgtacaactcctcgagcttcgaccacggtaccatcgaagaagtctcgctcagcacatggatcaccacctcattcgctaggtacatacggatggtactcaccgcctgcatctgtagccgtttccaatcttgcacctccatggtggttggcttttcctcgcacaagagagcatcgattaacccctgttggatgagcacgtccttcatccttgcctgtcacaaggagaaattgctcttcccatcaaatttgttgatctctatcttgattgattctgtcttctccatcttcagtcttgctcatcaccgttgcaatctacgttcttgtaccacctcactctgataccacttgtgggtggatgtctggccaggataccacctcccaagaccttttcagtaccacacgatgcagcaggaagaaagaataaataaaatagtaacaatcaaaatacaaaaaattttactataaaaaagaaattttacaagaggagatctcatccttaaccctcgtacacccaatttctctctcactgaaagtttctcctcacaaatactttctctcttggaagacacccctgaacccatgaagcgaccgctatccgctgtccaagagccctactccttctttctacagcgtacagcagctctctcccttcttcacaaagtgttctctggatttttcacggccgtacgaagccaaaactagccaccacacattctgttcaccgaccaggcccttttaaagggcttaaacctaattagattaggtttagacgttctaaacaggcccaaacaaaccccagatcaagcccgaaccattggatcctgatcgaaagctctttgggccatccgaacatgctctagttcatggaacagtaccgtagattgcacgaaacgcgtggaaaatgcccatgtggtccacagacccggccatggaccgtccggtccacagtggatcgaggtacaggcccagacgcggtgcccgagcctgggccggcccgcgtgcgcaggcctgggccgcgccccgcacgcgcgcctagttcgagtcatgtgcccgcgcttgggctgcgcgccccacgccgagctgtgccctgcgcgnnnnnnnnnnnnnnnnnnnngcctgcggccgcaccatcgatgctctgccagcctgccgccggcagtcctccaccatctcgaattgcgtgccgacttcaaaagcacgtatcttctccgtccgagctccgtttgggatgttgttgatctcgttggactccgtttttcaccgtaaatctctctatgagctcaatgtggatcgaatttcgagacatcaaatcctaacgaaaggtaggattcatttttacatgtatgtttgcaggacaaaggtacccatttgagtttgc

SEQ ID NO: 4 - protein, 236 aa, Elaeis guineensis
  wild-type VIR, RTPAP1_mrnaAA
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHLGKKVEVENKKAEPSADAKVIKPRPWKVPLQWLWSEDQQSCGSQQPQEKFGIPELPTISENDEAWLNCIMNGDRENSAVPDVGNGSTMNLQNEFGIGGLEENRDGAVFLEGVLGWDDLLWATI

SEQ ID NO: 5 - protein, 215 aa, Elaeis guineensis
  VIR mutant #1, VIR Event 1 mutation, SNP_1AA
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHLGKKVEVENKKAEPSADAKVIKPRPWKVPLQWLWSEDQQSCGSQQPQEKFGIPELPTISENDEAWLNCIMNGDRENSAVPDVGNGSTMNLQNEFGIGGLEEN

SEQ ID NO: 6 - DNA, 711 bp, Elaeis guineensis
  observed partial coding sequence of mutant #1, partial coding sequence of VIR Event 1 mutation, observed SNP1
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttttggtcagaagatcagcaatcatgtggaagccagcagccgcaagaagagtttggcataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaattgagatggggcagtgtttctggaaggagttctaggatgggatgacttgctttgggccactatatag

SEQ ID NO: 7 - DNA, 923 bp, Artificial Sequence
  synthetic reconstructed complete coding sequence of Elaeis guineensis VIR mutant #1, reconstructed complete coding sequence of VIR Event 1 mutation
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaattgagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 8 - protein, 205 aa, Elaeis guineensis
  VIR mutant #2, VIR Event 2 mutation, SNP_2AA
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHLGKKVEVENKKAEPSADAKVIKPRPWKVPLQWLWSEDQQSCGSQQPQEKFGIPELPTISENDEAWLNCIMNGDRENSAVPDVGNGSTMNLQN

SEQ ID NO: 9 - DNA, 923 bp, Artificial Sequence
  synthetic reconstructed complete coding sequence of Elaeis guineensis VIR mutant #2, reconstructed complete coding sequence of VIR Event 2 mutation, SNP 2
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaattaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 10 - protein, 177 aa, Elaeis guineensis
  VIR mutant #3, VIR Event 3 mutation, SNP_3AA
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHLGKKVEVENKKAEPSADAKVIKPRPWKVPLQWLWSEDQQSCGSQQPQEKFGIPELPTISENDEA

SEQ ID NO: 11 - DNA, 923 bp, Artificial Sequence
  synthetic reconstructed complete coding sequence of Elaeis guineensis VIR mutant #3, reconstructed complete coding sequence of VIR Event 3 mutation, SNP 3
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtagctgaattgtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 12 - protein, 185 aa, Elaeis guineensis
  VIR mutant #4, VIR Event 4 mutation, SNP_4AA
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHLGKKVEVENKKAEPSADAKVIKPRPWKVPLQWLWSEDQQSCGSQQPQEKFGIPELPTISENDEAWLNCNEWR

SEQ ID NO: 13 - DNA, 921 bp, Artificial Sequence
  synthetic reconstructed complete coding sequence of Elaeis guineensis VIR mutant #4, reconstructed complete coding sequence of VIR Event 4 mutation, SNP 4
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtaatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 14 - protein, 162 aa, Elaeis guineensis
  VIR mutant #5, VIR Event 5 mutation, SNP_5AA
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHLGKKVEVENKKAEPSADAKVIKPRPWKVPLQWLWSEDQQSCGSQQPQED

SEQ ID NO: 15 - DNA, 761 bp, Artificial Sequence
  synthetic reconstructed complete coding sequence of Elaeis guineensis VIR mutant #5, reconstructed complete coding sequence of VIR Event 5 mutation, SNP 5
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaagattaatgctttgggccactatatagtgcttatatatgggatgacttgctttgggccactatatagtgcttatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 16 - DNA, 3973 bp, Elaeis guineensis
  genomic interval of VIR gene in virescens palm, genomic region DNA from mutant palm
atacaaccctaacccctgctggaggatacgcccccacagcattggatttgatgaatccaccaccatgccccaggagaggaaaaatttttgacgttgttcctggactaggtccatctccttgacaagaactataactcatcaagcatggatctccccattttcatcgccgctccgtaatatatttctacttcaagggccggcttatggtggaccaataggtgcttcatgcaaaggatcgagaagctactgaccatatccacgcaagtgcttctgcgcgcgtacgtggaaccacaagctagcccacgtatgtccccagtcttaaccgaacaaatgcgctgtatctgggtgcttataaagcatcatcgagaccatgaagtaacacacgcttacagagtatcttgcaacttgaaattgcagtgaataagctaaagttctggcctcaatgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggtaagcgattccttgcttaccgacatttgtggcaaagcaaatcgcaaaaccttttctatcctgaactgaacacacaaatgatcaaaattgctcttcaattcaacaagtatccaagcgcaagcgtatgaaggagctgttgtcttctcatcccagcacagcctaactcctgattaccttgtctcacatctttacagaataaagctgaagtctgttactcatgggtattagtaacaagagcaactctatgaaaccctgaatactttccctcttctgtactctgaactgggtgtgaagttggtaacttctcacccttttttatttcttattattcctactaaacttctgtactctttcttatatttaatgcaatgactcttgagttaggtcttccctaactcatttgcatcaaaaaaaaaaaaaaaagtggagtcttttgtcattcttgagctcattgtgcttttgtggatttgaaggcctcagaaggtgccgaaagagctgccgactacggtggttgaactatctcagccctaggatcaacagggagaaattttcggaggaagaaacagatcttatcatcaggcttcataagctcttgggcaacaggtaacaacaaactatgaagatcgttcattatatatccatttgtttatagagacctttatatttgttttgtcttgagagatgccaatagttttgcttctcttaattcatattccttacctgtaaagtgaaaaaaaaaaaaaaaaattctgtgagatcattcattatgtatgtgtttgtttttatacagctggtagctctggtggttggcacccctctcctgaggaactgttttatgggcatagaaagctcaaatcctagtattggtaaattaccatcatattactttaaccgaaaataatacttaaaaaattattgcataattttcatatgacaagttaagaaacaatattaaagttaaacggcaattacaatacaaaatgcttcatgccgctgatcaacaaaaggttcattatgtttatgtggcaaaagaggattaatttgattgaaggtgtacgctagctaacgtagtaacatgttggactgagaaaatttagtaacatgttggactgagaaaatttttgcaccactaattaccaaattctagctttcttcttatgttgggacaattaatcactaaaaaaaggataagatggtgcaaatcccatgaggaaccttgatgaagtacaaaatagagcatatttcatcatgtactgagcacaactatcttcagaatttaagctcgtgctatgtgtcttgtttgcttcatagactgtcacactcgaaccctctagataggttgacgcatgacacggccacacactccataagaaattcctagagaatgtgacatagtcaggaatcttcttgtactttgaatgtcccagtataggttccaaacaagtagactgataaatattgcatctagatttagatttaagcgcaagatctttcttttgctgaatgattttactgtattccttttgcagtagcatgtacatcaactcttaaaaatggaatctatgcacttaaacctatacccaagacgttgtgctttaggcctaaagaaaatacacgataatatcaacacattttcagtcttttcgcacaatcgtatatttgatttgttggatttcattcttgagatcattccacttcctccgaatgcaattggcgtacgcaaccgcgggcctctagctctatttgctattttcatgcatcatgcttctcttgaatctcttgtcctccaagggaccctctctattaaatcatcacagttgaacacaaacaattcaactaatgagatctgaattcgataaatcaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttttggtcagaagatcagcaatcatgtggaagccagcagccgcaagaagagtttggcataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaattgagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccagaatggaggtctaagcttgagtctaattagtaaatgatcatgaagcatttaaaagcactctataaacaaatcatgataatttatttccatataggcttggtcagtctcgtacccctttatttttttgaacgctctaggaggggtttccaaaatccaaccaaaaataaatggatttctccaaaaatgattaattaaaaggcttgggtataccataggtcaacccaaaagtgttggatagatgtctgatcaagacaccatcttttaaaattttttcagtaccacacgatacagtaaaaagaaaaaataataaaatagtaacaatcaaaatacgtggatcagtcataaaaggactcgtctccacgagatatgcaaactttactatgaaaaaatttttttataaaagaagatctcaccctcaaccctcatacacacaatttctctttcataaaaagtttttcttcacaaaagctctctctcttggaagaccctcctgaatccctgaaacgatcactgttcgctatccaggagcattgctctttctctctacagcgtacggcagctctctctcttcttcacagggtgttctttggattttttgccgccgtatgaagtcaaaatgagccaccgatcaggcacttttaaagagcttaaacctaattagattaggtttagatctcctaaacaggcccaaacaaacctagatcaagctcggaccgttggatcatgatcgggagcttcctgggccatccgatcgcacttcggtccacaaaacagtgtcgtagaccatgtaaaatgtatgaaaaatacccacgcggtccacagaccaggccgtggaccacccggtccatggtggaccggggtacaggcccagatgtggtgcctc

SEQ ID NO: 17 - DNA, 1956592 bp, Elaeis guineensis
  locus containing VIR gene, genomic interval with 5' and 3' flanking sequence
  modified_base (1)...(1956592): n = g, a, c or t
acttagtattttagtcctgattctctctctctttattatatatatatatatatatataacagttttggataatgttggttagatttatgctcagatctggtcaaatcgaaactggataatgtagattttacatcgatgatccaagctgtagaatataatcaattactttaaaactgcttgcatattaaaaattatataatttgaagatttctaatttatatatcaagtgatcaaaaaatataatctaatttaattttatttaaactagatctaaatcatataatttttttgtgtacaaatagttttgagttagtaaatcacattcaatgacttggatcattgacgtaggatctttattatagagttttgatttgattggatttgaatctaaatctgatcaacctaattctagtttggctcgcgtacgcgcgcgtgtgcgcacacacatatatataaaagagttatgggataaaaaaaatgagagggagaaaacaagaaggagacacaagctgctgtcaagttggtacaactgcacttatctttccgatcttttatttttttgctaaaagtgtaaaaaaaaaaaggagaaaaaaatttaactgtgatcatagatgatttgtatctttttattatacttttctattattatctcatttgagagttctcagatattcttatattggatttctttatttatcttggtggcattaagtccaattcttaaaaaggaagaggcaactttatcatattatttctgccgatgatgctttgaagcgaaaaatataatcatccttgttctctatatactccaacatagagaaaaaacaatttcgtacaagtttcttcatattttctttgatggtttgtcaccaagttgtttagcaagcttatacatcaactgtagtaacttgtaattgtaatacaagtttctttctattttcttatggataaccgatggcagtatcctatatatagaggaccattgcaataaaagagcaaattatatcttgcatctcatgtgccaatgtgattgtgcatcacactaatcaaatcatctcattcttataagccaatcactaaaatacgtatgacgaaaggggcttatatgtgtgagataatttgattgatatagtgcatatggctatatggtgcatgcggtctagaatgtaaaaaaaaatgttggctatagcatatatccgtatcgattaaactgaaagataattttctacagcttcaattgggaaaggcgttccaacccaacttgatccaagtagccgactaatattttgaatcagaaacgttagatttgagttttattggttagatttaagttggatggggtctggggagcgaacggcgaatgaacgcagccatggttctaagtagagagagatctacgatcacagccatccattatatcggcttccgcactagcgcattgcacgtggacgagcattccgtggagccccatctgagccctcgctcttcctccaaaggcctcttcgttctctcctcctccgtcgttccgccgccgccgcctcctccgctgcgtggtgaagcattggggggcgccagcgatgtccttcagagcacgggagatctacaagaaggtcgttcggaaggtgggggactcggtgccagcggaggtgctggaatcgatgaggaagggcctccccaacaacaagctcgttatgggcagggccaagcgcggcatctacgccggccgccacattcagttcggcaacaaggtcagcgaggacggcggcaacaagtactctttggcttaccccctctccctctcctatcctcgattccgttattcctttttagggttctgtctgatttctgttctttgatgttctctttggttttgaacttacgctgaatgtgttaaaaatttgatctttttaaatattttctattgcaagttcgtaaagattctatctttgtttggattggtcttgagaaactgatgcgttggtagaaatgaggtgtatatgaggattttatttgttttcgttggggcaaataaatttaagctgttacaggatatggcttgcaagatttttgtgaaactggaattacaaggtttctcaatggccgtttccttgaattacgtataactgtgctggtattagtgtatggaaatgagcggccggatttgcctttcttattgtccgatcttggagtcatccactggctaaaactattgttttaagtcatttcgtttctcaaccagttaattgcagtatatccccatcggatcaccttgagatgggtaagatgatcatagaacttgtagtacttagtgctgataggtagaacgtggaagagagggaaaaatgtttgggtggttgatgctcaaagtaacgtctacatctgtttgttgtggaggtttctatctggaactcgagtgtgatctaaaattagacagattctttgttgggtgtatgaaagaaaggcccagaactagatatattggcaccatcagagaagtacaagtaaaggatccatgtagtgcagcagaaactttggacttatggttgcttgattttgagtgatccgcagtaattatgtgggtaacgagtacttgcaggtagggaagcaacccacctttaaggatatatatatattttttttttgtttatttggctgttatccttatgccaatgaatatctctcattttgacctaaacaatataagcaggattcagggcagcaaaaaaaaagaaagggtgaattgattgtgttgatcttgggaagccagttgttagaattgacaaattgctagtatgaaatgtctacctaaaattctctattagattttgtggtgtttgttgcacccattgattgcaatatgcttgcacaggtgattgagtataagctcttatatctctgcatgtgtcatgattaagtgtttgcaattttcaaaggatgtttctaatgtatcataggctttatatgctagtgattagttttgattgttaaatagtgttagatgtcactaaatttgttgtgttggagcatagttttttgcaaaattgacagtacacggtggctctatggtctagatctgaaggccaaagtgccaaactaagaaacacagctgacacccgatgatgctggacatctcactttttgatgggatttacgttgtaactagtctgtcctcttttgaatttttctatgtgaaatctgatagcaattatttctttatgtcatttttcattttagttgcatttatttgttgaagttacaatgtcaacatgattaacacataattgcgtctatttaaaagtctaaatagaataaaacatattgactcttcgtcaaatcatctcgtcatctggctttatttcttagtaagttttcggaagtggttttgtttatcatgtgagttgtggaccatctaattaaaagtgcaactaatttgtgttggtttctcatttctggtagttgtatgacttgaatcctttacaatatcaatcaggggaatatacctcaaatgtaccataaaatttaaacttctttcttgcttggataattgtgatgttgttgtcattcctttaaatttgtgataatgtcaggaaatttgcatcacatgtttattgctatttaagggcagttctttatattatttaaatctgtcactgacatgacttatccttcatttttggtgcggagtctgctcattatactatcagcaaaagaacccaatctgatatttcaatattcttgtgataaaggtctagacggacatggaagcctaatgtacaaacaaagcgcttgttcagttatatccatgacagacacatccgggtcaaggttacaacgcatgctctcaggtgcattgacaaagctggtggcatagacgagtaccttctgaaaacaccttaccataaaatggagacagagatgggcttagtttggaaggccaaggtcgagaagatgtacgagcagcttgggaatatggaagtgggtttcttttctcctgaagaggaagccaagattgaaaagggctttgaagaactcaagattgccaagagggatgctcgaagggaagcaagaagagctctggcaaaacaaaggcagatagaagaaggaagagtcaacagtaaggagactatagaagcaaagcagactgataatgcgaagaaggctgaacaagaggctcctaacctgtcatgattggtgagtcagctgaattatcttgctctattcgttctctttatcctcatccaggttgataaagctataggaactcactagtttgtagtttgtagcagagtagagttgaagatggaaagcaggtcattaggagaggatcaataaatgccattacaagcagaggggcctgaccaaggccttcaaggtggagttttcttttattaatcaaatggcttaagtaggtctagtcttttataactgcatggaacaatgttgttgatcttttgtttgtaactgggcatgacttttggcccttaaaggtttgacttaataccttccttattgaaattgtcagttgcttacaggattaagaaattgtacagctattttgtttagctgaaagatatttcatggttcatgcaagtttggctacatggattattggaccgcttttgaagcttttcttttggcttgcagattttgtcatgggaaattaatttgattctgtgcttacagcaaaagcaatagttttgaatttatggtcctcattggtccacagttacgttggacttcaggtgttttgcttaatccagcttgtcaaacctgcaaacatgtctatttgagatccgcaattctcttcatcaaagtcaaagatctattgtttttgtccattatttcttcttccaattcttggccttccacaatgtcatatatgtgaacagagaaaataaggctagttttgttagctggtagcagcagcttgcccaaattggagagaattttataatgcttaaactgcaagtgttttgttatctgcaacgaactttgtctgtgattttcgtcatcctaaccaaatatttcaggtgaccgccaagtgacaaaagctcatgttgctaattcaattcctagagtagttggctcagacagttaggcatatcagaaacatgaggtcaagtgcttaatggttaagatagtgttcaaggatcggttttatctacttaatccacctcacgcaaccacaaacagaaggcagcaatatgtaaaccaggaacaaagaataagttgtcaccagagatgagctccctgaaatggatattttgcgtagcatgtccttttctaatatttctttgcaaaatatgtatttaatttacgatcgaaatcgaaattagaatgaaaatttgaatggccatatcttctaatgtatttgattcgcgaacagaatcggaatctaaatgagatttgaatatttaaagagaatagtgattgaattttagaggattaagatattttcatccatttcgaattggaacggaatggcactctactcaccaaattattagaatatgagtttctcatttttattttcattctaaaatcgaactccctcggaccaaatataggcaatcctatcataaaatttgttctttaatctgagctaataatcagaggtcgtagctccataagaaatgctaaaatgatatttaattcctcattctttactccttagctggaactactccaaatcaaaagatagataaccaacatttggaatactctattactaggaatcacgtccataactagtttgatattgacaaagagtaaagagaaggttaacaatacacaacagagatagccttcttctagcctagtttggcaaggacatcattgagggcagatttggtttctgcatagtacttctgggcttctggtacattcttgatcttcgctgcatgatccagctgacgataagatgaggcaagaaatgttagatgggcattagtggggtcgatatggaacaattcaacttattcttttttctacttatatatgctactgtatttacctcagcaattgtggcaaagagcttcccagcgagctccttgaggggcttcttctcttctttgggctttgctgagataacagtatttaggtcaaagcggaggtaagaggccttgagacgaaggtcattttggacgtagggccattgcttcttgtctatcaattccttaaggttcacaatgtcctttgctgactctttcgcccttgctgcagcttctgctggagcaagtggttgcaggtagaatctttccttcagtggaaggtcaaggtctctcggctcgtccgaatttagggtcccagctgttacatgcagaatcatcgcaacattgaattatgcatacatatatatatgtgtgtgtgtgcacgtatatttatctggaagaacgatcattaaagtacattagaattgagtttgatataaggcaactgtggatggcaccaatgaaacataagtggtgaccattttgagatggttttggtgtttctagtttctatgtatttttcttatttattctttgcatatatatatatttcatgagaacgacactgaacaatggtaaatatttgagctagaatttagtatctttattcttgttacctcaaagtatttaaaaattggtattttcagatcaattaattaataggaaagcatgtgttgatgcaaacccaaggagggtacagagaaattggatatattcacaaacacctatgtgatattgtgtggatgatccaaaagatccatagtgcacgtaaccaaactgttgaatgcttcctttcattacttttcgactcttcgacaaattaactttgtttttgatttatttgataaagttctttgatgtattagttgatttgataggaagtgaggtgtgcattaagtttggttctgtcctagttgttcagtttttaattgaccaaatttagttcgtcatcttgtcattcctgctgtgtacgagataaaaagttgttaattcaagttctaaaactcttaattaacatagcaattactcaaagaaaatcaattaaatcagatcatcaattacagcaactgatctagcaattaactgactaaagtaaacatatgtcagatcaaattcatatcagtttagcttcttgctgtgtactccttgactctggactagctgaatattttttatgaggttgaaagtcttctgagctgtctgacaattaccaaattagataatttcaagctatctcctacattactccaatcagtagtgatcatattctaaaatttttatcattatattttgatataaaaccgttcatctatgcatttagaagattcgagcttatcttatgcatgcatcaaatagtttgcatctgtcataaaatgcaaaaatggatgcggttatgaatccagaactagtgagcaccagagattgggaatctacttgggacttatctacgagaaagctttgttactccactagttggcaaaagtcaaaattctcaggtccgttcgccattagaggttttggctttcaaactagaatatcgtttcattctttaatataaattttctatctaaaataagtgtagaaacttttagtgaagatatttgactgctaaagaggaatcaagtgtaggacaaagtaagtaaaatttgtaaatttcaagatcagtttaaattaaaactcttcatgcagtttaaaaggcttgaaaaaaatcatctaattccatattataagggcgatccttttgtgtgtgtgtgtgtgtgacacaatttaaaatttctttcaaaaacacattattcaccagaaaaaaattccaaataaaccccaaaattcaccattttggtccttgactaacctcgtataatttgactactgtgacaaagaaacaagtagtctccccacatgatcgcctactacaagactatttcatcaatgccttcattcagttgcattatttcaaacgaggaaaagaatcacggaggaaaaagatagctagggagttagaaaataaatctagaaaaggttatactgtaggagaatgaatgggccggacacttacggagcccaccggagggtgggggaggtgggcccaccttgatccccttcgcctccgcgagcacggccttgacgactgacccgccggcaaacccggcggctacgagccccagcaccgctcgacgcccactctgagccacacccactccctcgccctctgccgtaccttgctgggccctcaccgtcaggccggcccggcccacggacaccctatagttccccggcagtgccagccggctcgagccgctgagctggagacttccctcgagtaccacctgagatgagccacgtaagccagccatcgacgccatagcttgcgccatttcctgatcccctctctctctctctctccctctcccgtttacgagaagggcgagcgcgttcgaggttttattcgggcagcgggcgcagatgccttatctgcccgttaaataactggataagttgggaaccactgagtgatggacacgtgtccggtcttgtggtctagtgtatcagcgaatcgatgagttggattgggttgctgcaggaccattaggagctcgacaagtgtttggcgggctcgaacctcctgacatgcatggtttcaatcagataaatgatttaccgtctgcaaaaacattttgctcttcctcgtatctgctaatgtattcatgactgaattgatctgaaaaccttgaagtgcccactacgattttttagttcacttgtgaacattgctaattgatgagttgatttttggatcatgtgcatgcatagtttactcgctgttacatctttcagttaacattcaacctattcttagcttgttgggtcttaatttctggtgtagccttgagtaagatgatggactgacttggtaacgattgtttccacgaacttttccttgaaaagaagatctttcaggaatgaggatacgtaacttcttaaacgtcgtcctttttaactgagaactgttttcttgcccgggctgttggatggatattgtgattgacccagacctttagcttatttccacaatgtcctcagaatctttcttcaaaaacataatattctaaaaatcgtggaggcatatcaatattgcatccattttattttaattttgcattgtcttttttttttttaatgataaaatagaatgttcatacaacacgaatataaatacagtccacaaagttagaaaagaaaataaccctaaaagcatgtggcaaaacatcaaatttcgatcggatagccctctttgaataatcagcaataaagctcactattcagttcacagcgttatttatctcacaatagtcatgtctagcatcaatggaagtgcacttaaccaacatatatcggatgtcacggataaaaaggttgaaggcaatagttccacccaataatgactccagctcaccaccatgtggagtctcctttgaccaccgactggtccaccttaagaatacacctcgcattgcccttctctgggattgtgaaagatgtatattgttatggttttaataatatggagggcatcattagtcctatattagttgtgagtcaaggaagacacgcttataagaaggaaaaaattcttctcacatgagacatcttttaaagcgcaaaatcatgaggttcatgggtcagaacagacaatacctcacatgatgagccgagccctatctgcaacaatggcacgccaggtaggagttgaggtttgccttggttctctggaactatggtccgtctcgattgactgtggggctccttggattgtatacaatcagagtcccccttgattggagggctctgttgtggttctaataatgtggaggacatcattagtcccacattgattgtgagtcaagggagactcgcgcttataaacagaaatttttttttttcacgtgaggcattttttaaaggacaaaattataagatccatgggtcagaacggacaatactttatatgacatactgagtcctataatatatatatatttacaagcaataacagaggaggttggacttttctccttacaaaataaaattaggaaagcatggatactcattaggtgaggacactcagcgctctgcaacgatgtcttaactttgatttacccaagttgtaggtagcagactatccatttcaaactattatagaacgtgttaatggataaactatgttccatttttccaacaccataggaattttcaggaagtcataaatacatttccccttggtgatgtccaagggccacacctaagattgcgaacaagatgatcacccaaacgtcacacccttcctttgcttggagaagtttttgggttcaagtcgcgaatggtgcgtgcatgagtattttagggatcgtgacctacttcctaccagcccaataggaaggttgatacgctctcactacaatgcagtaatccgaacatgattggcaagaggaagaggagtttatctagcacagaacggagtacaccatccaacctcacatcctcttgcaacaagctgtcccaagtccccacccaatttgggccttccaccattgtgaaatgctatggattttgcaatagcaaccaccctgcaaattgaccgttgatcaagcactacaatgttctgcggaagcagatcttagcatcagagaccgttgaagccaccaggaactactagtgcgcgatacttctttaatacaatgaacataactctctttcctctcccaaccttgccaagaaatattgtaagctggttccaaagattcctcatctattacgctacatcaaagcagacttctatatatggagaattatttgttattcgtttcgtaatggagaattatttatggtttaattaattaaatacattcgatgttgttggttttacgtgatctcctccggttattccttggatagcaaccacctcaacaccaaacaaatgtatacaagaagaagtcccgaatctttaaagatggaagcaacaagtggaccgttcgtagaatccctcttctgcctggggacaatttatgagtcttctcttggtgtgtctgtgaaccatcaagccactgagcatgcaagtgttttatgaactcattccttgtcatttgattgaaatggagacttctagagctccgaagatttcctatggacaggataatgataatgccataattaaactgttgaattagtgcaacaattacgccattcggatcatgacctccttaagaataacttctgtatctgcatagcatgactctgtcaatgaatcactcttcttcttcacggcctcttcaagctgtcaattgatgaaaatttactagttagattgttggcccatagaaatcttgacatcactaaaattatagaaagtttcaattactttacatgttcttgaaatctctgttgccatcaacattgttttacgcatacccgaagttatagcaaatttaatgcaaatcatagttctgaggacaaacttctaatgtaggttgagtcaagcagagcaataaatgaaaaaaaatgaagtgcccagggatcaccttttcgacactgtcgaacaaccggttggcgagatcggtgaggggctgcttctgctccacaggagctgcagagattagcttatcgaaatcatagtacatgactgtggatttcaggcagaggtacttcctaacgtagttccaggcatcctgccccagtaggtcccccagagccaacagatcaaatgcgtagtgcttcagcctgtagggaattatttgggggcctagttttgctatgtagatccctttcctcaggaatgagcgcgtgcctgtctccttgttagcaatatctgtgggggaaagatccttgttagccatgtccattcttatctccactctgttccgtagtgaagatgctgtgttaaattctagaggttttacgactcggaatgcatgtgagatgaaatgaaaccaaataagatgatgcaatggatgaagaaattaaacataccgctagtgattattggagctggtattgggccagttagccacaacccattgttctcctcttcagcatgtgaaattccagcaccaagtagatgaaagagtgtgacagtagcaaggcctacagaagctctcctcgaaacttgcaaggagatgccactgctgttatgaagctgtaactgaggttcttggaacccatctatgcttttgtttgcaaacaccattagtcttgatgacccaaggtttggtttccaaatcttcaacagtctggagggaaatatttgagaagttccactcagattggacacagcagtagccatggatttggaggaaagaaaagtggcttctaaggggatgcatgcaaggctgttaatggatatagttccgtttgtaaggttatccatcgatgactggaggctactgaccactcaattcatatcgatatggagactatgggtggcacggtacttcagctaaaggacaaactggtctgcgaacaataatgaatgtaatattatggtcatatttgtttactgttcctctataatcataatcaattcatacgttaaaacttttaataaagctcatgaattttcgcatatctttcaatagttctggggacgttactaaggctgtcactggttcaggggtcccatccaaaactccaaaggccagtgagaggcccaggcctaagaaggggacatttttttttggtagaactaaaggaggggactaaatatggggaaaaaaaaagaaagaaaaaacagttctcaactagcaatggataatgctcaacttggaaacctcatagccattgtcattaccccaggtccaagatatgttttgactttatatttagaccattttgatctggtataggtgagctgagcaggagcccgaaatggcttcagtttctcctgagtcgaagccccttcaggctatttatttctaaatcgagccattgcaagaactcacttccatttcatttcaggccaatcaaatgaatgctttaagctgatcccttagccagccgagtctcctaagttcagctacatactattacctaaaaataaaaggttcagttacatacaatcaaacaagcccttcaaaaccatgatgttaaaagacttattattcaattcaaatatctctctctttgccatgcacaataattttcctagaaatttcagaagactgtagatgatctgccgatcttatctgaagcatgtgatttaggacagaagaaataaaaggttcaggaatcttaacataacttttcccaggaagatggactgtataaaccgaaatcagttgaatatgcggacttatgagacgcatgggaccatgggagttgcgaactcattagtagaagaagttccacccgcggcgtttacactattcctcagcagattccatataactgaagtcgggcattaaagtgccgattctatgcgaagcttttgaccgagtttggcaaattttctcagcgcatccggcggctccaatttgggacgagctggtttgacatccggtcgagggcgtctaaataattttccgtttctgaggaaaacttggccttcaatccccgcgcacatcctctctctcatgaatgccttccctcttctcaaatctctcgacttccagcccagaatcctcccgccatcgttccttttctctctatatatccgtttgtttcgtactccttcagtagagagagctatcacagagcctctgaactccctccaatgcgggcatctacttcaaatcatcaccaacttcaaatcactggagaaagggcggcggctccacgcccacatggtcgcctccggcgtcctcctagacaacacatatctaagcaccaagctatgcgctatgtatgccatctgtgggagcatggccgatgcccgagctttattcgacggaattgctctgaagaacccctttttgtggaatgtgatggtcaggggctatgcttgcagtggtttcccccttaaagctcttgacttgtatcgcgacatgttgagatccggcagaaaggccgataatttcacgtacccatttgttctgatggcttgtggtgatctattgctcattgaagttggaaaaaaaattcattctcagataattgtttgtggatatgaatcggatgtttatgttagtaattctcttctgtcgatgtactcaaaatttggagaaatgaagcttgctcaggacctatttgataaaatgctggcaaaagatttaacttcttggaacacgatgatttcaggttatgcgaagaataatgactcagtaagggctctaacggtcttcgctgttctggccatgggtggaggaggaatggaccgagcaactcttctcagcatactgcctgcctgtgccaatacggcggcattaaagcaagggaaggaaatacatgcttacatgctgcgaaacagtttggaatttgatgagtttttaatcaatgctctcatagatgtctatgtaaactcggactttatagctggtgcgaggtgtttgtttgagaagataagtaggaaagacacggtctcatggaattccttgattgctggttatgctcgtcatggtgatgctgttgaaagcttaaaacttttctgtcagatgaactcagaaggtatgtttcctgatgaaattactcttgtatcagtgcttggtgcttgtgaccggatagcagcattgcaatttggctggagtctccatgcttatctcaccagaaagggatttgataacatggtcatcgtggggactgctcttatagatatgtatgccaagtgtggaagtttagattgttctcgtcaagcttttgatgagatgccaatgaaaaatctggtttcttggactgccatgatttctggatatggacttcatggaaggggaagagaggctgttgcttgcttcaatgaaatgaagagaaaaaatatgggacccgacaagataacattcacctcagttatatcagcatgtagccatgcaggattggttgatgaggctaaggaaattttcaaccaaatgtcaaaggaatattcaataagccccagtgttgagcactactcatgtatggtagatcttcttggaagagctggccatttagatgaagtgtacaaactaattttggacatgaatgtggaacctaatgttgatgtttgggtagcttttctttctgcttgccgcattcatcacaatgttgagctggcagaaattgctgctcagaatgcttttcgtttcaacccaaagggcattggtgcttatgtctccctttccaacttatatgctgtggaaaagaggtggagtgacgtagagagagtgagagccacagcaaggatgaatggactgaaaaaaccacctggttgcagcttcattgaattggatatggaaattcataggtttctggttggagataagtcacacccacaatccaagtccatatatgccaagttggacgaattaagacaacaattgaagaaagctggatatatcccagataccagcacagtgttttatgatgttgaggagaatgtgaaggaaaagatgctctgggatcacagtgaaaggctggccattgcttttgctttattaaatacatctcctggaatgaccattaggatcacaaagaaccttcgggtatgtggggattgccatacagcaactaaactaatctccaagcttgtcagtagagaaattgttgtgagagatgcccatcggtttcatcactttcgcaatggatcgtgctcctgtggtgattattggtgaacttatgcttgatggcaattcaagcttttttgaaggatcagcagattttgtaagccgattgcttttattgctcactcaatcattcttcataatgtagattttactaatattagtaggtgcacaactaatgattttacccctaatccatctgtgcttaaatattacgattttgtctttactataggatatttctttcctaaccatataactatttaaccttttagttaaacttctttacatctagaatgatttcccctctatattctttagagtctttgaaccgtatagtgttatcatttttcaaaacttcttcagctatatgctgatacagaaaatgctcaaactctagtttgcccccttcttttgttgcacatatatgtgtgggggatctggttattcagtaattctctggttgcctaacttagatccctgctttgtgagtctgactggtgtctctaaaaggtccatggagaatttgaaaaccaccagtctctgcttgcactttccaagaacctatagattagctaattttaaatgtttcggaacagtgaaattaaaatattgactataaaatccaattgaatattttcagcatctatgacaccttagagtttctgcagaaagagtggcacagatctattccaaatattcgagcttgagctacccattcaaatatatccaaatgtgcagtaatatgatgtgaataaaatgcaaagaaaagccattcagaatatcaaatgggaacaaacatcaagaaaatatgatcggcccttgttcacatggcatttaaccagtactcatacataaaaatgactaatgaaaagtatttgtcaatccttattcactaggttgcttattcatggtgacctcactctctgaaggattttaattcaatatcgaagttattttgttgaatatatcgtctacaaaatcagcaaaatcaccacctacactcatatctgttactggatcaaatgggaatggcttcattggttctgtggcttccagaataacctcaattggtatttttggctttgatctttccataggtttaatgggtttgaaatacttgcttggatctggacagtaatcctgaaacaaacagatatgattcaaactacaatcgatcttttgctaattaattgcatatactctattttggaacataatatgattgtgaaaatggggtgacagccttgaaggaagaattttacctgatcagcatgcattttcctcacaaatgtcttaaatattctgtaatttatggcttttaatagctcatctgatagtcggagatatgtcattgaagtgaccctcagctttggaggcccatctctgttgacaccatttggcctacagttcctcaatatctggttataggctttcctttcatatcggttaagtgcattctcacatgcgacttcaattccctctctccatcctgcgcttagtacctgacataattattcaactgtctcataagtcctattatcaaaccatatactcagttaagtgcttggcatatttataccttttacttttaccattgatttacctgctgaacgagttcctcaggcccactcttagcttctgcagtttgctcagaatctctcatttcaacacaagtaaagttcaagatagcatcatgtctagtaagcattcttgctatggttctgtagccatctcgattgtttaagttgtagtatcctgcagtgagctctgctgcatggttgtcaactctataccaccagtggatgccagaaatctgtcatagtaataaacaaccttatatatcactataaagaacattagtcagcaattaaggactggtacaaatttaaatagagtttatactttggctgcaagcttggttttgcatcctaagaaggcctgattggctgcatcaagaatctgatctccatgttctatcaacttgtttgaataccaagttaggaaaaattttcctttctcagtaagatatgtcccattttctgcaaagaacttggtagaatcaggtgtgtcattgtattctcctgcatcatctggcaattcccattcagggtgtcctgcctttgttgctgcctctttgaagtctgcttggagatatttgtcataacactgcaagatttataaacatatgttttctttaaaaatatgttttctgaaaatgaattatataaatatgttttggatccttatttctgtattcttacaaaaaagggaggagaaaacattgcacaagaaattcagtgatgactggtataaacattttgaatgcaatccagatatcctatccaattaaaaaggtcctatttgtcagatcacttaaatcctttcacatcacttaagaccacttgcaatggtagtcaggagtctttgttgcatctatttctgctttaacttatctgtcctgtttttccatttattcttgatttcatgtcattttttgttatgataaaaccagatactttacatagatatgagatgtatctataattagctttgtacctatctcaagttttccttgatctacgtgtgaaatctggacttgcacttaacatatttgtgattcttctcttcacctttcacaaatttttagactaatataaggttttttcttttgttaatggcagagcacataaactaataattgaaatctttcctgaaattctccaatgcctggaaaaacccatccttggggctgtggataggaggggtatctcagctctccagcagggccaaggcccacctctatatctgtgatcagaccagcttccaagaaatccgccatgttttctctgaagctcttcatgtagtcactgtagagctgtcataacggataaacaatatgtgagtccaataattaaccatctctcattcatgtttgattaataataagcttcagtctagacaattacagataaacataacacgtataaatgtttttctgaaaacaaatccaaagtgtcttgctgtcataaaattctccaagttaattccaaatatatcaaaagcataagagatttttatcaaaagttcttactcaagtttttgttggctcgattatggaatatacatctcttgatatttagtgatttttattgatggctagttaattaatttgaatatttcttttagttttgagaaaacctgcatattttatcaagatgtcaccgataattattttatttatttctatgtttttctctttaaactctcccttctttttatgtctttctattaaaaaaaaaatcaatttcaggtattcctgtcggatgattaacgagtgtgcaatgtaaaaattctcaacaaataggatatgactttgtatttatttttcttgaacgctcaagggtcaaagtctctcatctttctctcttttttttttctgaaaatatagtttcctattaaagaagaggaagttaagatctgataaggatgtgtacaagataagatcatacagttacagaagagatctaaacttcagaaagtttgaacatcagaatgtggccagcattcccgaatttgacttgaaactatctagagaaatcaatggaaattaagatgtactgcactttttagtctagtttcacatcctatgatggatttgatttagtaatataatttttttcccagataactttagtgatataaattaaataatttcgtatcaaccagtaactcacagaactacaacgcctaatacctaacgttgaaacaataggcaattgtcattacttaaataacactgctaaagatggactctagtaaggcataaaatagcaaatatcaagcactataattactctgcaagtataggtggaaaaagagagtaaacttaatccagctattcattaaataacttgattttaatttgagaacaaaagcattttgatcaaccaaacctctgctgcagtgcgcccttcaaaaaggggctggttatccactccaatggtgagatactcttcattccttgtgcctgctctgttggtgtagaagatatccgggtctttcttaccaatatcacgaacccactgtggtattgagatgttgacgatgtctcctacattcccaccacattgatggaaggacatgatggcctgcagcttaagcccttcttccttgaccatctggaacaactgcctgtaagcactccaatcatatttctttggactcaaggcttcaatgattccccaccaaacatccaccatgacaccatcgacatctgctgctctcagtttcttgagctgattcctgagctcttcgggcttctcgaatacattctcagctgcgacagcacccaactgttggagaggttcagatcaaagaagaaattgttaccgcaactgaaatagagacaggattctaaatccatgcggttattagagaacttaccgggagcatcacatatactggaacatagtttgctagcattttctcctgttgcgtgagaagggttggcatctgcatggtttgtgtttggcgaagaaaaaagtcagtccttttccttatgcctgctttgagagaacggagaataggaaagttgttgcctatcctttggactggaggagggtcccttaatttttggacgagtagcacgtgaaacactactcaccgcaaatattttatcttggtccgtgtatgatctcattttcgaatcgtattgttagtgactgcatgtgtttttgtaatcattgaaataaagttgctcgacacaacccgagaatatcttttagagcttattattcttcccgtgataatatgattgatttcgtttattctttttccccaaattttggtgaaagtaaatgtcttgaaatttgccagccaggaattggactggtttgataaaatccattattggtctgctgcttatttgaaatgattcggaaatagtatgcgtgccaaaatgtttaaggtctcaaacatgttaccaaaacaagctccattgccgtatgaattgagggtatactcctttacatcacaaccctatcaagttccatcaagaatttcatcaatcccccatgtagtattattgcatggtactttttattagtagagtatgtttctctccttttttttttaaggggagattgaggaagtgaaatatttcccctagcatttgttataactagagtctagattattagaggaagagagaagatgaaagtggttgatacgtatgtgattgacttgaacatgatgtttaatggagcaagtgaatgctatgctttctcctccacgctagaaagcaaagtgggtgcctaatctatttggcgtttatggtagattgtcccatgcttataataaagtgacggtcccattgcccatctgtgtcatgaactggccttaccccaaacagcaactacttgatgtaatgggtacatgttccagtctatacaacttagtcgctgtatagacacaggagactgccaatcaaatgtggcaacctgaaacaatgcattgcaatagcaatactatgaggaagaattacctcgtattctggagacatgcttggagcctcagaggtgacagcctgaggagctccaaacctcttagacatggttgggccacccaacaagagaccatcactagtgtataccttcctcgacctccctgtaaaaacgttttgccgctctctcatctgaattctccgatggaactctgtccttagtgaccaagttctcttccctaagccacccaaatacgagatgcttgtcatggtgaatggtgaatacctgttccccaactctcgcaaagaattcaattctattcttccatgctttggagaggaacatgtcgatgaaatttatatttacaaccatgggagaataagtggtgggtatgattcttttcttgcaaaaatctacaaagctttgtatggtttgattccttttcttttttagtttgtggtgcacgctagttttgaacatccatgtgtatttttcaagtgccgtttcttgtagtctctagcttgcagatgaagacaagaagtctattgttcaagagaaaaggatgcaatgcatatgtaccgtccatttattactgccaaacatccatattatactgatctttttcccgttaccttttccttttcttataattagctgtttaattatttgttactttcaatcttctattatctttctttccggagaaactggttttctgatccttcaaggcaaggcaatgccatcgatgggcttgctcaagctagtccttcctaagtttggcaagagactgaggtcctgcgcctgcttaacattttagtatttaatcaaaacttatccattaaattgacattgacaattggataaataagtttcaatgatttattttgttaaaaagcaatgttcagtggtacatacatgaagctgaaactataccaactactaaggtaattttaggatctctgttttttattttcttctgaggggaatgataacatctatcagaaatcagttttgataaatacaacgatataacgccaccactgagaaatgccaacacttggaccaaagtattagttcacaaccaccagaatttactgtcatcacaacttaggtaaagactaaagaagggttaaaaattgaaaaagcttatctcattttctaaatgtgagtccttgctgagctaaaaatcgagcagaatactagctgctcaaaaaagctgaattgataacccccgtgcattcatgggaagtgcatgtaatgagcgctttttgctggtcccaccatacccactcatcagatttgtcaatcttggccgtgtcacgcgagtaaacacgatgggatcacaagaacggtgcttaggatagatttgaatctcctggtttctaggaaatttcaatggaaatattccacacgtatacaagtgagataattttctcgcctcagtcccccgaagctcctagtgccctacgaggagccaaggctcaagatttgataagagttgatactttttattattcttattattttatgttccctctcacgctggggaaatggtgaagagggcaaatactagcacaaatccagatgagaagaatgccaatggtacctctttgattggtggctggccttccacgttcaatatcaaattacatgcgccatcctccattttacaatcctagaccataaaatttgggtataaatggatgtttttttttttctggtctatattgtccctctcttggttgtgaggagaggccgaaggagaagcttgaagtttgtatcaaaaaggaggagattgaaatagcgaggcgaggaagaggaaatagagggagagaagtcactaattattgtccccccatctgtgacattatgtttgttgcggctaatctcctcgtcgcctggtcgccggaaaacgagcgcctgcaaaagaagtccacactgaccggagatgcctccgacgggaaccctccgacggtcaagtcagagaggagactaggcaacagtagagatgaatcaggagagctcagcgattgagagagagagagagagagctagagagggagagttcaggggcttcaaaagaatctcctccggcactgttgccttctccgttttataatagagcgcggcatggcgccgtcattaatggcacagacaatggagagttgtcaaatcgtcggaggctgtcagaaccgccgtggggctgtcaaatcactagggttgacccatgtccagggtagaacgatgtcccagggcggctatgccgcacgcctctgtcaggacgggcggccttcagcagtcgtacggcatctggaggagtcgaccgaccatacgtcggcatttggttgtaggatgtcggatagggacaccgtcagctggcacggcgcatcgcagggatcggacatcggccaccacccccgatggtcagtctgatacgttgccaaggttgggggtcgggccgtgtcgttgggccagtcgagaacggaaagggtcttccctaccgacataccttcggtcggacggtgtcggtcggtggagtcgggcgtcggttaggcgggcctgacggtgagtcggtgcgagagcgaccggtcggtatatcccaacaatgttcatcataaactcattattaaagatagataagaacgtagaaatgaaaaatatttttttcagttgaaatgagtagacaagaagagaaatatcaacgcattactcaagggagaaaagagaaaaaaatactgaataggatgagttaaaaatttagcatataccaatattcaagcaaacgagttcttggatatttatattgaaaacaaacccaaaacaataacttaccaagcctgctagatttggcattcgcacaccatgcacgtgctttgtcaaaagaacttgtaaaaaaggggacctacaactggtgtcattttttcccttttcttcgatctcacaatgggcaggaaaggggatggcatcagttcatgtcagattggtgctttatggactctgtcacactccaaacccaacatccggatcagatacgtgatgaccgcacactccttagaacaagtcctaaagaatatgcaagaccaaattaaatcattacaactttatcaaccataatatttaatttcaataataattcataaaacttgcataattacaattaacattccttcaatcctctgatcagatatcaacggtacctatctatgcatccgctcactcacaaatccataccatagccaaccatggacatcttgtaactttgagaagaaaagaaagatgaagggatgtgagttttacagcccagtaagaattctcatatcacaccaatataataatataatctgaaaataaagataagcaataacacataaaagtcgatgttcactgtccagaatattgcaaacatttatagattatctgttttatcaaaagagatgcattatcatatgttaataagtgaaacaattttattcaacgattgtttcatgtcttatctttctattttcttctattattacatcgtctttaatccttttctttttggctttggctttggactaccaggatcatgcgacgaacttttattcggatcgatttctgtgatcttcctcggatcgaaatattcatgatctttttcggatcaaagtggccatgatctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtagtgggttgtgggctgattctggacttgatccaaagtccaaatgggccggggtgttacagactctgcttatcactctttttacttttttgatagatgacggaatgcgttcaatgaagaggcaatcctcaagcaagatcacaacttcaatacatatcaacagtagtctatattacgtgatgataaaggcaccaatctatttacttgagagtacgtacatataatcttcgtgcaagttgtttattttaatcttagtaaattcatcattcctttctctaaaggaatcattaacttgcaatatcaccacttaatgacaagaaagataatttctcggacaaatcataaaagaaaggctaaattgagtttggatcctatgcggtgcatcttttgcaccattaatagctctgcatgtatggtttgctgccacgtcgtccatgttagaaatggaaggctagctctcgctctgttgtgaaattgggaagccaaacatgtgtggtttcgaaacacaccatgcagacagagtgagaaagcccccccgccatttctgagataagcaatgctgtagtaacccagatagttataaacctcttgtgctacaaatgcatcgcaaagaatcgcactttcagttaaattctcagacaacatgcaagactactgaacaaaagaacacaagagaaggataagttgtgccctaatgctccatgcatgcatatcaatataccaatagaaaaaagctattttgaatgtatgtccattaaacatgattcaacggatctagggatattaattaaaaagctttcgcaacgatcaagtattgctaatttgctaatcttaacatgtaaactatctaataagtagaaagccaggatgtcacagagatgaatatgtgatcagttaccatgcacttggcatgaaccaagaagccctaggtctaagcgactccggacctggcaagcaaatctctcgttgacttccgtcttccattgagaactctattatcttgttggagacatagcttgtaatatagacgcagttccctctgaggcccgatacaacgcactcatcggccggcagtgattccgacctccttcggcctacaaacaacacctggtcacccaagctctttacggcgatccatctccggttagccatgtcaagcttgaacacattaacatacccagggaacagtgcgaccatcatgagctccccgccggattcgaccaggtccttgttcagagtaccatgggccgtggtccaaggaagcaccaggaaatccgtcacgcggggctaggcctcgtcgaagccgaccaccaccacctcccccctgacgcccgcggcatatagccgccctcggtgaaaaatgacgtcgctgtaaaccctcagcccgtcgtcgaacaccctccactcactgtcccccacgcggcaccaaatcaatacaccatccgtccccttcaccgcaacaatgcagttggatgcggtcggcaccgaggagagagcggccttccagtgggtgcagatgttgcgctttgcgcccaccggggtgtcctcgaagaacttgaagccgggatggtgcgaagggtggagattggagggcagctcgatttggaccttggagactgggttcaggagggtgattctcctctcggcatcggatgacatgatgagccagccagcagaggttccagcaatatgtgagctctcgtagcccgccggaagctggagctcgatgtgccggccttcgaagaggctgtagcaggccaggctccttcgactgcccgcgggggcgccgccgtacatcagccatggagggtggcgtgggggaaggaggcgacactcggacagtgccaggcgccacgaggtgcagacggatgcaaaccggaggcagtcggtgagtgccaggcgcctcagaattagttctaagatttctggagggagccgggtgtacctgtctacttcggccctcattgcggcgatgagaagaaagaaagacgctgagaaacgggaggacaggttttatttgtagggtttccttctctaaaggtcgtgttctgctatgattctatatgactaattctattttatgtaggtctccacaatacatatagatatatattctttaaaaggattaaagaagtctcgagttcagttaggggccccagattccctggtctaaacgcctttcagcgggccacctagaactcagatcagatacctggaatttctcttccgggaaaaagaatatattttttttattcccttcgtttttttaaattttttgtcatttagaaatcctaattcatgtatattccggaaaacttcatcttcggaattggatacatttttttttctttagtacttttaattgattgagggttccttctgcaaaaaaatagaaaaaaatctatatatcctctcattttataaatgcccaagattaggactgagtacggttcggattcgattggatgaagaaaaattttatctgactgaattcaatcgaattaaaaaaaattcaacctgctgccaatcatttatcatgtataaatcatttgaaattgaagtgaacggtatgtagcagattcgagtggatttactacaagaaaaaaaattattagcaatagctaatagtcagtttgccgtcactaaaaattcgaagaaaataatttcatcgttaattattattattagcgacggcaaatccgtcatcgctaataaagataattagcgacggtattagcaataaagttctgttgctaataatattaatttttttaattaaactattaaaaaactattaatgacggcgattttgccactactgttattgctaatagtttttaaaattttttaattaaaatttaaaaaactattagcgatggtagatagcgtcactaatactgtcactaaaagttttttatttttttaaaaaaattataattaaatattttaaaacttattttaatcacattaacaagcaacaatattttttaaaatctgttataaataagataacaattttgtaacacaatcataaatataaaattaattatattatattaaaaatataaattatataattttacatacagatactactttacaaatatcaaaattgcatatatatatatataaaaaatcatgtatgatcctccttgtcatcctcctcctgctcctgtacgttctctccagcagttggagaatgagagccggatgtctcagcatcctataacaaaagaaataaaatattattaataagtttcgatatgaaagtatatatattgatatggagacgtatattttgatttactacttcgattcttgaacatattatttttatatattttatttgatgatatggagctatagacacctctgatccatcgtttggatagttagattgaatttttaccccctatatatttttcggactcaagtctaaacatgtgaagcttctaaatataaaaaattaaaataagtaaaaaaattattaatagacttatctactgtgatggctgtgacaatgagcccagttgatcatacggatgtgaattctgaagaatctaaatgatcgtatcatggatggcatctcgaaaactctaaggttgctggctctaaagcctcgacatgattttctttgcatgtacgttagcccatatctggatcgttgagccctaagaggaggatgtcgatgaagatctttgaactggtagagggtcaaagctgtggccgaatcctatgatccgactcctactcacccctccggtggccctgagccatgcatccctcgaggtcaaagaggggttgagaggatgagtcctcactatgtcacaatacgagatactccgtataatccatcaatacagtttaaaaattcattagtctatatatatcagtatatataaaaacttaataaataatgtttcaagttgttactgcgatctgctaagaatgaggatctaagtaatcaccagttctcctagattggtatgcggcctactatatttatagctgccctggtgcacgacccagctatcgtgtctataataaataaataaataataaaattaaattcattaaaatatacaaatgattaatttaaggataaaatttttattaatttgtcggccataatatatgtgccaacggagccgtcagtatgcttgattgaatgctactggatgaaccgattatgtcataccctttgtcgcctaccagagtactccactggtcgtggagggcctcctatatgtctatctatattcagtgatttgtgtaagacttttagtccgatggtgagtcagaattggaatgctctatggcagactgctgaaggctatacagcctatctcgaaacctccacgtggccacctcttcaaaggtccgacggtcagcctccttatcctgaggagtctcaaatcaatagcacctctacaaatagaagcaaccatatattaataaatagaatacaaacttaccacgaatttaaaaattaaacatctttgacttaccaagatatatcccaggctgcatcacaagcccctgatggccaactggagaattcgttcactgactccggcattaatcattggataatatcagtaaccacataagacaccccaggctctataaatatgctgtaaaatttattttgaacaataaatgttagactttaaaatggttaaaatttaaatatatttagtgaggatttatagtacttacgtgcagctctgaacgtggacgagctctctatcctccgatcaaattggaggtgctacgagtcggatggatcctctaccacgcctctaactctaagagccgagcgcagctccgtgtgactgtggagtcactggtgactccacgacgtccaaacttgagagtatcaagatattataaaaatattatattagataataaagaataaaataatataagaaagaatatctaaagtattagagtttaccatatagtacgtgtggcgcagaagcatgcgagatggtggtatgagagctctctcttcgactacaacagctccgacctcagaaagatatgatctaaaatctttgaaattaaaaataactatgtatcatattggattaactatgtaccagaataaaataactatgtatcatatttttttaattgtatatcagtatgcttgcgaatctcttctttgtgccatctcatctgtccgacagtactcttggataagtagagcctccgaagcttgagagtgagggaaaagtatcgaagagccttatatggtatatccttttgatttttatcctcttgtctcggcttaaatcggctttcaccgcatacgtctatgtactcttcagttgattttccttgtagaaaagtatgtaagtattacggcatgcatctatcttctcgtatcccatgcctaacattttcatcattttttttgaagcatagaagctcccaacaagcttttcatccttcggtaacatcttctttattattgctaccattctatcataacaattgactgtcatattaaactctgctttcaagttcaacaactctgacacagttgataatataatatgtatttcatatcccggccttagtggttcatcaacatctttcagtatatgatagaaatcattgctgtcagcttctagatcgtcctccatatcccagttaaatttaggaccaaccgtatccataactatatctaccattctgtctgtgtctctgtcttactgaggacttctaatctttgtaattatctctcacgtctccccatgcaggtaccaatgcttttagtttgacataaatctactcctatataaatgggcaattattgtatctctatcaaatatttctctattgacacatctcttacaaagacaacgagtccgtttttaaactaagagtgtagcattcccaaaagtataatcatagaagtatttgacaccctccttacattcagcaaaaatcacttcgtcgactattcgacagtctatccaactacgatctatggcacactatctaaggattctacatatacaaatataagataaaatatttatcaaatattttatcatttaaaatgacttacataataaatacatcatatcatcaactaataggtatagaatatcctatcacattcaaaaagtatattaattatataggtcaattatagtaatcaaatgatatgcaatagaagtcgaaaaatttttgacagtattttttcttaattctcgccacacgattgaagatgtgtgagaagaactaaagaaaaatattgtctaaaatttttctcatatcctcagcatactatttgattattgtaattacttatagaattaattataatttttaaactattcaaactagacggtcaattgatcaatatacataattttttgatccgtttaaaaatatataaatatacggatgctatagaatagtacattaatcaaaagatggacctatcattatatgcaatataatactttaaaaatttttaaaatactgagtttctaagtaaaagatatcattgtaaatggagacagtcaggatgcacattccacatatgcggacttggagcatgccaaacgactagaccgtgcgagtgcaccagcatagcatccaaacaaatcccatcctgaaggttttaaagtatcgagcaggattgtaaataggattggaaacaggctggaatgggccaggccacacccctccttgagtttggtctaaattttttttggacttcgaatcgaacttaagacctatagtccaatcgttgagctgctccgaccaccatcggagtaaatgagcaggctagagccggtctgatggtggattgatctcgaacctttgccatcgaagatagtaggactactctcatcggagagctttccaaagtagttctacctttcgagaataatattaatttatatnnnnnnnnnnnnnnnnnnnntattaaaaatttaaaaaaatagaaatgggttgtggcaatggtgatggagttgtcgccgttgccatcactaaaaattatttggtagctccgatggtggcgcagattcgacggtgggttgacggtgcggtgctccgacgccttggcatccgaaagggggaggggtggggggagaagggagaggcagtgggaggcttgatctggcaagaggaggggcagggggagagggggagaatggggaggcagtgaggggcccgatctggcaagagaaggggcagtctggtgaaggaggaggcggctggggctccaatccaacaagaggtaggcaatccgacaagaagaaggctcaggaacacgtgatccagtgagaggacactgggtcggaggtggggatggcagtgcaggggttgggggaggaggtcgggggctccgacggcacgatgggggagaagggggattggagatggggggaagaggacggctcgggaacatgcgatccgatgagaggacgccagatcgaaggtggggacgatggcgcaagggctgggaggaggaggtcgggggcttcgatggtgcggcgggggagaagagaggtggggggaagtggggaggcagtcggagatctgaggggtatttttaaggtacactattagtggcagctagctttcatcgcttaagttcttgctaatagatatttttaaaatttaaatttataacgatggctttgcctttactaataagtattgaagccatcacttataattcgctaattttttagcaatgaaaatttttttcatcataacgttcggtccgtcgctaatatgttttccatcgctaacacgattatcgattaaataaaaaataaaattattagttatcaatgatggtaaaatttttgtcgttaaagccgtcgctaataagctattagcaacagaaaagtcgttgctaattaccaattaagtcgtcactaataatttatcgatttttagtgatgaaaaattttttgatcgtaatttgctatcaataaaaagcactattagtgatggtttttctaccattgctaatagccatcgctaatacatgattttcttgtagtggttgtatcggtttagacttcaacattgactcaatattgattttaagtccaatgttgatccacttaagcttatttatttttttatcaatttaatataaaaaaatttaaatcttataagttaaaaattttagacttatttttgaatatatacaaaattaaacagaaaaaaaaagatttactcatctgaaagctttcacttcagaagtatctcaaattgatatacttccaccaataattgaatattaatattcctatgaatccaaaacaatatgtccaatatgctataaagcttaaaaatacgttgcaagaagcttaaaataaagaaggcagaatctaaaaacatgagaaaggcatcagccattccataatatatcagatttatctgtatatttacaattgtcatacctgcaaatcaattttgcatactagctggatataaactaggaattaaatatcacagactaacataccattcaattcatatagaaactaggatataataattttataacatctataagtcaatacagaacatgtcatacttatcaatttttaatttaattttcaattttccaaatctatactaaatctgtaccaaataagcaaatctaccataattcctattttttaaaatgaaagtgagtttgtgagatactacattggtcagattctatttcatatggattaaaagtataggaactgaaccaatcgtaaataactgatttttttacagatcccaacccgattccaatcgatttatatatttcaactgacaaaaaccaatgtttattgggttggattggatggatttcttcggatttcgattatttgctcagccctacccaagactattagccatgttctccttaaatgtccaggggcatgctggctgtggcctctagttgttagttatcgtatgaccctcaagctcttctcatcattggatacactatcaatttatttgaaggaaaagctaagggagctaggtagataacaagataatttttatttattatgttatttatcatatctagttgtctaggagcagtcgcgcatttgagaatatagattagagcccctagcttgctctcttgaaagctcaactgcaagctttagagttcatccatacaattgcctctaagtagttcttgatagtctgggaaaaatggaattctctttttgcgctctttgcgcattctaatctgatttatatcatcagggaaccaacacctcttagttcctcaaaatcaactatgatggcatttgttggatgatgaagcccatggtgaggctaggcttgttatttgcaatcttagttctctcctagtggtcatagggggacgtcatctatatgacgtggcgattccatcggcaagattgggagaggcttgggaaggttctaacctatgcaacgatggttctcaaggcaatcaatgttgttttggagggggatttcaagattgtaattaactggagatctaacttagcagcctagaggtgatgaatttcacccagttatactagaccattggaggattttctcattaattagcgatatcacttgaagctacaagtatatggataggctaataatatagcaagttggatggcttcctatatagataaaacacacaagctctatcctcctaaatactatggcatccatatatgcctgctttactttgtcattggttgtactcgggctctgatggatgcatctacacaagggctatgtaacactgacaccttaccaaaaaaggaatgatgaggcttagagaactgacttcggtatatatgtctttgtttgatgatttttaaaatctcagaatgtattagtttaggatctaatattgaaagagaaaaagaaaaaaaaggggcttgaggctgagtttatcatcatagaaaatggtataccaacaactagattgatagattagtaaattaggtggcaactgatgacatgagccattttgtgctattttggttctattgttctaaaattaggtttgagttttggtaagattttatgggtcgattgagtctagcttgtattaagaatgcaaaggagttgagttactcacgagctacttgagcttgactcgagtctaagctcaactcgattcggttattatcagacttgagtaactcgaataattttttaagtcgagctcgagtagtaggatactcgatctaaaagccatgagtctattcgaatttatatatatttttaataatatttttttatttatttataaataatatattattagtaggttaaggctcgattttgaacttgaactcgagcttgagtatggcttgattgatattcaagttgagttgagtcgatttcgagttttatctttttttttcgagctaagctcaagcataagatattaagattcaatcaagctcgagctttcagctacttgacttagtttggcttgattacatcccaagttatatttagatcaaatgatcctgttaggatggcttgaatcaaacaaagtttgtcccttttttatcaaggttgactacgatcataaagcatagtaatcattactctgtccctagctcaggttgggctgttcatgtggtgtagtttataagccaggcaacatcaagtcaagcttaggtatagataggacaggctcaggtagagcaatcctcattctatatcatagtaaggtttggtgtggttcaagcctgcacaaaatattactcttaacaatattcaaccctcacttgacccagcaagattaattactacttgagattggatattaaagcaaaatatatgccttcagatttttttttttttgaaagaaaagatataaaatcagaaatagcataatcttgttcatattgcaaaatggtagttgacggtgagctgtaacttacagtacaatactgatgaatttgattgtaattgaaatgtagaattatgtaacatcagttttttgttttcttataaaaataaaatttattcaaactactcaaattagaccatgaaatctcttactcggaggtgctgcaattaaatattgggcctttgagaggagaatttttaacagagaggttaagaagaagatattgcatgacatcaaaatccttgataggaaggaagaatcggctgacctttccacctcggagctcgatgctagaagaattcttagagcttttatggaggacctatataaaaaagaagaaatctattggaagcaacgattaaggattacttggctaaaacaaggtgataggaatacttcattctctcataaagtggcatcaagtaaaaaaagaaagaatcatcttgacgttttgttggatggcagtattgaatactctaatcagaaggacattgcttctattcttcactcattctttaaggatctctttggatgaaatacagcacctaagttaaaaatcaattggagcatgctttttgactcaccatcccttgacctatctgagttagtgaatgcctttactatggaaaaaattagagaggtagtattttcatttgatagtagcaaagctctgagtcccgatggatttaccttctcttttgtacaaagattttgggatatcttgagaaatgacttatttatcctattggaggagctttacagaggacatcttgacttggaacgcctcaactttgccttcatcactcttatctcgaagaaggaaggttcagccaaggaccttaggccaatttgcctcctaaattatctttacaagattataacgaagattctttcaaaatggctcaatcatttacttcctattctcatcgataaatctcagtcggtatttgtaaaaaagagaaatattattgattgcttcctcagcgcacataagatggtggcatattgcaagtgtacaggtgaaaaagggttgctttgtaagttggactttgggaaggcctttgacaaattgaactgggagctttttttgaagtgctacatgccagaggcttttctatcaaatggattgaatagatccatcgccttctctcatccgcattcatttttctgttagtgaatggttctaatagtagatagataacatgcaagcaaggccttaggcaaggggatccaatctcaccttccctcttcattcttgcagtggatgttcttgctcaattactccaaagagcgggtgcattggggttaattgaaggaattggtagccttaaggagtacaggggcattttgagcttacagtttgcagatgatacacttatattttgtgctgggacagaaaagtttgttggtagccaaggctatcttgttggcatttgaagctactttcaggctgaaaattaattttcataagagctccattcattgcctaaacatgaacgatggggaggcttcaaagtttgcatcttgattgaactgcacgaagggggatttttcgttcatctatctgggtctgctttttcattttaggaagcttccaaagcaatgttggttacctttgattgaaaaagtgagtgtgagacttgcaacttgaaaaagaaaattactttcatggggaggtaggttaaccttgatcaatgctgtgatatcaaccttgccttcattttcatgtccatcttcagactaccaacttaggttattagtagaattgacaagatgagaagagctttgttatgaaaaggttctgatgaagccaatgggtttcaccgcctggtgagttggaaagttgtttgtaagttcaaagaacaagagggtctaggtatcaaaaatttatcccaattgaacaactctttgcttgctaaatggtcttggaggttccttcgtggggcaaatggtccttggtggtaccaaattgcaagagcttactactcaagcaagaagtttggaatgcaaacgagaaagtcgactttggggctatctcccatttggaaggatatcggtttgaagaatgaggctttttggaactgtgtggcttttaaatgcagcaacagaagatcaattacattctggaaagatgcttggattgatgcaattcctctttgctatagttttgatgatctttatgtacggacattggagtctaacttgcccatttcatcattttggaatatgagcacgttgaggtggtatgtcctgttgatggatcttttgataaggcatgagtcatattgattatgaccttctctcttttatggtgccatctcatatcgtagatgttcctatttggaagctttcacataatggcctttttactgttgattctttttacaagttcctaaattttggtggtttgagatgtctttttcaaaatgtaatttgaaaaatgccgagcccagagaaagttaaagtgttttatgattggcagccaagaatagattacacactggtgaagtgcttgctaggaaggattggaatgttagtactggttgctgcttttgtggtgctaactttgagttcattaatcaccttttcttccattgctcatttgcaaggagtatttgggcaaccataaaattatagttgattcttaaaggaagaccagtgagctttcttgatctttggacatgctggagaggaaagaacaaaaataaattggcaaagaaggtggggcatcaactttttacagctacttattgggagctttggagggagagaaatgtctgtatcttcctaaataaaaaaaattcagtattctcagtcttacagaagctactacaatttttttttgattggagacatctggattctactaagtttcaggtgcaatatcaaaatttatggaataggttgtggtccctcgctatgcattccactccttaaagcttcttcttgggtgggatatgagttttattttgcccataaaacttcttttttggatgggatatgagttctgttattgtccataaatcttctttttgcattggattctaagcagagcttgttgctcttttaatctgtatctataaatgctgagcttttattctaataaaatgggggcagctttgctacctcctattcacatcaaaaaaaaaaaaaatctcttacttggagagatatactcgtgagcattcaactatggctttagagaatctttgtataaaaaaatgaatcagggtgacattagagaataaaatgggtgcactacatagtaaaagctttctgagtgattattccaaaaaaatacaaaatcctgattgaaaaacttccaggagcacaagttgacgcctgtgcatattattcaaataaatatgaaattctactaagaaaagaggaatgtgaaatttaattggaggaatatcaggagtactttgctaagcacaccatttgaatggggtgtatcagagacgagcctgcatgacattaaagagtaccacttcctgggggcattattattgcattggggaccagaactttacctccttcatcagttttctatgctgaattggtggccgcctggattggtttatcagttgctgtcatgcatcttaaagcttctagtatttggtcggaagttgactctatgaaggttatttctttgattgaatgctcctcacctgatgttgttaataatcttcctattctaaatgatatcctgaactggaaggtttcttgttataatttttatgtttcttacattcaaagggaagcaaaccaagctgctgattttattgccaagttgggtcttactgcaaatcaggctgctgttgatcatattgtttccaatccttctttccaatctattctgcagggtgatattcaggaaaaaatgtcttgagaagggactggaatccattgcgcagctatgcttcatcctctgctttacagcataattttcctcttcatatggcttctggcgccagctcctcagcaatgcaagttttcagcaatgcaagctcaattccttttccatgctatgtgttattttggagtagaaatcagctttgctgacttctgtatctttgttttgattctcaatactgtatgcctttcctctgctgcttctacgttggcctgtttgtaatcactctctttatgttttaatgcaagctgtgctcctctagtttacccaaaaaaaaaaagagtaccactaaatgctttgaatggactcacacgatttaatggacatactaagaaacgaaagagaggaatccgtatcctaaccccaaagcttttctccatcgtccaagaaaattaatatggtggcatctcgcaaaagtgtcatgcaacacaaacaaaatgcatgaacaggaaatttagattagcataaacacatgcatagggaaaaatgttataagattcctcttccattcagaaaaatgtcgtgaacaagttatcattagttgcgttcgattttaagccagagggctagccctttttttcatcattgttccaatattgttttccttctgagatcctttaatggcaaataatgtgcatatcattgtgatgcctcacattgaagaccttgaagataactctcctctattcgttgcggtgccatttgaaagggttggggaagtggaaaatgccattgctgacaggtatggaattccaaatgaagatcaacttctcgttcaccttggaactttgatgaaggatgatgactcatatctgcatgaattcaatataaatgatgcggcacacatcgatctgtatcggaggttgccctctggaacgatggttgctgttccagtccattggcaggaagaaatttactcgatcgagaactacaacaacgagcactcagtgcgcaagctcaagaagagactggacaagataggggtgggtgtgcccccacgtcgccaaacactgatatatcagaacattctgatggctgatgatgaccaattattggagtatcttaatgatgctcatcataatgatatttacctattggagaccccaacagatccagattacttgatgcaactgagggtgaaggtggaaggaacatatgaggaagaagtgtttgatgtggatgatgatgatactctgtatacgttgctagctaaagttcagaaagctggcctagccgatgatcgtgcatgttacttcatgcttgatgataggaaactggattcaaggggaactgttgctgaccatggacttctagtaggtgacattttgcgtttgatttatgaagaatagactaagcggacctgcaagtctttatgtctgagcaaccaaagtacttggcttatacttcagttaagcataaaatgtgggctgatctagctgaattgctattgtagttgaaagagttctgaacataggtcagtgataccaaatttaatagtcttatgcttaagagtcaagtaacatatgctttaaaaatccattatcttacattgtatagtctagtttagttcaaaataatgttctaaagaagtcaaaaagtatatgtgatgggcttgcaatttataatacgtccatatatgctcctatcattcctcacttcccttttagcttatccttcttttgaatatttgagcatgttccgggtgagaacatattgggaatgctagtgatcaatgagaaggccataaaaatgatgaaaagtttaataaattaatttggcaagtaatgaagttagaggagtggatgggtgagtttggttagacaatgggaacatgagctgatgcacataattaagctgctaggaagtcatggttcgcatcaacaaacatgggaactccattccacgacctccagagtccggatgctatgtagcgtcaagggtattcatgcatctttctttgtgtgtagtgattagcccttgaagtggctgccgggcgtggtagtgactggggatgatgccatggcatgcctggttacagatgaggtgcaaagcagcgcagagtatgggctctcattttccaggaaaagctgctccaattccatcagaaacaattgtttgaacaaaaactagattcattcacttttctaaagacgtgcttgcttaaagatgtcaggttagatgacggaatgctaccactctatttctttttattggctctgattaccacagctttttttttttaaaaaaaaaattatggatagattaacacgagttctaaatccaaacttcacagtgctggtaaatagagcttcgtatgattgtatctattcaaaaatggggttgagagaaggatgtccatgatcaacattctttttcaccgagcatgctcatgagccctcggtacagcacctgcaggggtgaaattaaagtattatcagcccacaaaccaagcccgcatttcacactttgtagagatgaccgtctcttggtggcacaagcaactagagggtgtttggttagggagaatgaggatctggaatcgaaatcgaaatgggtgactcccattccaaccatttggttgggaggagtcccatttcgatttggatttcggaatggaatggaaatggatcgatctacatagaactcaattcctactcttctctatgaattcaatttttcattccaattccaatttcgatttcgattccgattacgaaccaaacgcttcggagatttggccattccgatttcaattccaaaccattttcattttcatttttattttgatttcggttatgaaccaaacacccctaaaaagaatgcaaggtgactaagatattataacggatcattgttcacacttgagagagggagtcaatcaaaacaaattacaaattttatttcagtccatttactgctcccgcaattcaacaagctgtcccagatgagttgagtgtccaattaaaagatgcatgctcgagaagcggaaaagaatgatgagagtcttttgatgcagaaagcttagcttcccaaatcagaggatccgagctcctcctcccaccttgaaactctttacgatgcaagcaaaggaagctaatggacgctccgttggttccactgggaaacggcctaactgccttcgatggagtcccaccctccccatccaccgccgtcaccgaaggcgacggcgataactggcgtcgccacctcatcagatgccaatgtcccgtgcatttaaaagtatttaaggattctatattttttaaataaaaaatattaataaaaataatatttaaggatgctatatatttttaaataaaaaatatctggtgcaaattgcacgtgatatgtacgtatattctttgtgcaccgtagaaaatccgacgtggagtataccatcttgtccgattgatctatatagacatcattttccaatgtacatttaatatctgtacatcaatttttttatttaaatattttatatgatgaaagtatttttattttttgaaaaaaattatgacaacttgtgacatattataatccagaatatcataaaatgactcaagatatcataacatagaagcgatatttttttttaaatactttcgagcatgcatttaatgcctgcagatcggctttttcgtttgaaaattttgaataataaaaatactcctattttttagaaaaaaattatgacttcctatgcatattatgatattctgtattatattatgacatcctatgttgtattatgatattctgtaaataaaaattatgattttcttgatataggatgtcataatatgaacataaaatgtcataattttattaaagaataggagtattttcgtcatacaaaatttttaaatgaaaaagtcgatatgcagacattaaatacgcattgaaaagtggtgtttatatgaatcaatcggacaaaatgatgcactccatatcagattttctacaccacccacgatgcacaaagaatttgccaaatgcctaatgaatagaccgagtcaaaatgaattaggctggattcgggcttaaattctttgggcctaaattcaggcttaggctactccaggccgaagttataccttagctgggtcagaaaacaaaatgagctctacatctggcccaaattcgatttgacattatttgggcttagcccgtagccctaccccatgtcagactggcccgagcccatctttagcccagcttgtgaccatgtttctagagagtagaactgtagaagtggtaaaaacttgcaacgaaaaaattaaaattagaatagcctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggtgttacaagaatagcttgggaaataattgaaaccgtgaagtctaagaaatgatgcatgtgctaggatgtccagattgccgtcgtcttgggttgcaacaggctggggaagagctgggtacggtcaatatttccacgttcaatatcaaattatatgcaccatcctccattttccaatcctataccataaaatttgggtataaatggatgtttgcttttgtggtctacattgtccctctcttggctgtgaggagaggctggaggaaaaggttgaagtacgtatcaaatatgagaatattgaagtggcgaggcgaggggcaacatagggagagaaatcactaattatcctcccatctgtgacattttgttcatcataaattcattataaaggatagagaaaaacatggaaatggaaaacatttttttgcagttgaaatgagtagacaagaagagaaatatcaacacattactcaagtgagaaaaagaaaaaaaaactctgaataggatgagttaaaaatttggcatataccaagattcaagcaaacgagttcttggagatttatactgaaacaaacccaaaataataaattaccaaacctgctagatttggcattcgcaaaccatgcgcgtgctttgtcaaaagaacttgtaaaaacggggaccaacaactggtgtcattttttcccttttctcgcgtctcacaacagacagcaaaagggatggcatcagttcatgtcagattggtgctttattaatgaccctgcttatcactctttttaccgtttcgatagatgacggaatgcgttcaatgaaggggcaagcctcaaccaagatcacagcttcaatacatgatcaacagtagtctatagtacatgatgataaaggcaccaatctatttgttgagagtacacataatcttcgtgcgggttgtttattttaatcttagtaaattcatcattcctttctctaaaggatctcatgagcttgcaatatcagaacttaatgacaagaaagataatttctcggacaaatcataagagaaaggttaaattgagtttggatcctatgcggtgcatcttttgcaccgttaatagctgtgcatgtatggtttgctgccatgtcgtccatgttagaaattgaaggctagctctcgctctgttgtgaaattgggaagccaaacatgtgtggtagcgaaacacaccatgcagacaggatgagagagcccgccatttctaagataagcaatgctgtggtaacccagacatgcataaccctcttgtggtacaaatgcaccgcaaagaatcgcaagttttagttaaattctcagataacatgcaagactactgaacaaaagaacacaggagaaggataagttgtgccccaatgctccatgcatggatatcaattgcaaaatagaaaaaagctattttgaatgtatgtccattaaacataattcaacagatctaggcatattaattaagaagctttcgcatcgatcaagtattgctaatttcctactcttaacatatgttaactatctaataataagtagaaagccagaatgtcacagagatgaatatatgatcagttaccatgcacttggcatgaaccaagaaaccctaggtctaagtgactccggacctggcaagcaaatctctcgttgacttccgtcttccattgagaactctattatcttgttggagatatagcttgtaatatagacgcagttccctctgaggcccgatataacacactcatcggccggcaaagattccgacctccttcggcctacgaacagcacctggtcacccaagctctttacggcgacccatctccggttagcagtgtcaagcttgaacacgttaacatacccagggaacagtgcgaccatcatgagctccccgccggattcgacgaggtccttgttcagagtaccgtgggccgtggtccaaggaagcaccaggaaatccgtcacgcggggctcggcctcgtcgaagccgaccaccaccacctccccccctgacgcccgcggcatacagccgccctcggtgaaaaatgacgtcgctgtaaaccctcagcccgtcgtcgaacaccctccactcactgtcccccacgcggcaccaaatcaatacaccatccgtcccgttcaccgcaacaaggcagttggatgcggccggcaccgaggagagagcggccttccagtaggtgcagatgttgcgctttgcgcccaccggggtgtcctccaagaacttgaagccaggatggtgagaagggtggagattggagggcagctcgatttgggccttggagaccgggttcaggagggtcattctcctctcggagtcggatgacatgatgagccagccagaagaggttccagcaatatgtgagctctcatagcccgctggaagctggagctcgatgtgccggccttcgaagaggctgtagcaggccaggctcctccgactgcccacaggggcgccgccgtatattagtcatggagagcggcgagagggaaggaggcgacactcggacagtgccaggcgccacgaggtgcagacggatgcaaaccggaggcagtcggtgagtgccaggcgcctcagaattagttctaagatttctggagggagccgggtgtacctgtctacttcgaccctcattgctgcgatgagaaagaagaaaggcgctgagaaacgggacgacgcgttttatttgtaggatttccttctgcaaaggtggtgctctgcattgattctatatgactaattctattttatgtagagctccacaatataatatagatattattctttaaaaggattgaagaagtttcgagttcggtttggtaccccggattccctgctctaaacgccttccatgcgggccacctagatctcagatcacatactttgaatttctattctcggaaaaagaatatttttttattcccttccttcgtttttttaattttttgccatttagaaatcctaattcatgcatattccggaaaatttcatcttcgggactggatatttttttttttctttttttgctttagaagttttaattgattgaggatttcttcttaaaaaaatagaaaaaatccattggacgctcaaagtacatattttgtagagatgtttgaagtttatatggggcttaggttgatctaggaggattttcaaattcaatatagatttctttgagctattatggatggaactggataggatacagagatccatcataaaaagttaattcgtaagttaaatttttgaagattataattagatcatgtctaatttcaataattttttttttgaaattgattagatttttgagatctacgatacgatgccacctatatcaagaagatgatctccttgatgattaggacagattttttttataaattttgaaatagactgatcaatcgaaaaatatttttttttagataagactttgatcaactataactttctagtagagcaacagcaactagtgttaatcaagtagaacagcgccaggccggatcggcgacgcactggcagccctcagcatttcccgactatcctttcgccgcgaaggacgggttaaaccatcatccttatctctattatgaatcctgaagatcggtacggaaacccagcgatcagtcggctgctattccaccaaccagaagttatgcgtcttacgccgatgtcgtgaagcttggcactaaattttgccggtcacccatttgatcactccaccatcctgggctgtcaggaaacactaaatcatcaccctgggcctttccctaaaggaaggtgctttcagtgtggtgacaatggccacaccaaaccacaatgtcgaaaccctttaaaatgcttcaactgcagcgagtatgggcacaaggcattgttgtgcaagttgagaaacacttcatctgccacaacgaaacaaggaaggttcctgcgacaatgcaagccagacagtttcctttgccgggtcacggccttctcctcaaattccaggcccccctcccccagctcaggggtcggtgctaccaaagttttcatctcggttactgaggagatggaggaaactgagctctacttagacagggcgacattgtagaagctctgggttgcgaaatcaaggaggacaatgtgcgagaagccctttctcgcaaggcaaacgtcgctggtgtttggacaacacgtaaactcggaaatcctaccacctttttcgtggcttgtccatctagggaagtcgttcatctcctcctgacaggaggacggatcagaggcaatggattctcattacaggtgagtcattgggaccagtttagaggtggcataccgcatcaactcaagctcaaggttcgtgctagtttaattaaccttctactggtttgttggaactctcgcactgttgcaacaattgtttctagtcttggcctcccgttcagagcaagcaaagcctgccttaaatgggatgatctaactttgttcgatttagatttctactgtgatgacattgaggacgttccggagtcgattctcgtcacttttgagccattcacctatcaggtccaaattcgaatgaactttgtttccgaacaagttcctctaggacctccttctcttgcacgtactccagatgatgaggaagaagattgagaattttggtttttgggttcgaaaacccttcaccttcatcggggatccggagccgagtagcaagccacccacctagctcaccagctaggcgacaagctcatgctcctaggacagaagaaagcccaacgctcgacctacagcctaccgaaaccaagctaaccccagccaacccttttgctgatattctcactacttggctctcagagtttcttagagcctatctctataggctaagccttggaaactggttatttttcaccacctatccaggctcaagtagcgtgagcctcggcatggtatgttggaattcgaattcaaattcaaaagacaccccacagtgtcactctcctgatgggatcgtgatgggtcaagtggagttggctgaagaacatctgaatccccctcctgttcacaataacggaaacctaccgcttctagagtttaagtccacctgtgaaatggctggtgacgagaacacaatatcaacaccagggaaaagaatgcaaaagggaactgaaggcaaaagggtagtcccagtcacaacaatattcttccaaatactttcagcgaccaaacctgctgatgattggcacaactctcacacccttattgatcctcctcccaacgcaactactagcaagaatcaggaggttaacaagcacacacctaaacgtagtgctcgactctgatccaaaaagatcaaaaagcttggattagttgaggaatcactgttggagactgacatgctcttcctaaacaacttaacgttggcacagattactaaaatggggaagaaatgcgatctgatatttgccgactaccatcaacagggtagggtcccagggcacagttaaaagaaatggaggttcatcgatgtggtgcacccctggcacctgtttccacgacctcggccaaatgaagtttgtcacgctacttctgagtagtagttctatatcccactgtggatactgcctgtccgtcactgtagtgacgttttgtgtttactttcaagttctctactatgttttcattaggatgatccccctcggggactttttgtacatcagatatgattgcaattgtgccttgtttattgtcagtttatctggcaatagttggcgaatcaatcactttctttcgaatgcgcatgattcttagttggaatacacacggtgctggaaaaccaaagaaaaggagagccatccgtgataccatttacaaatcgaagtgccaaataatctgccttcaggagaccaaacaagaacgaatgactcaaacaacttcaaaagcagatttgtggaacccattttggtggatgggtagttaaaaatgctgttggttctgcaggtggtttactaaccggttgggatgatagagcattagatggcagtctcctccaacttggtcattactccatctcgatcaaattttgttgcaaagtcactaggttttcttgggttctctcaaacatttatagcccacacactgaaaacgatcgccgaaagctatttgcagaactcagctcactgagaaacaactgttccatcccctgggtcctaattggtgatctaaatgctactaaatactcctctgataggcgcggttccggtaattctcagaacatcttaagattgtttaacaaatttattagtacatactcattgattgagatatcgctaactggaaggcatttcacttggtccaatctaagggacgatccatcattggccatacttgattgccgtttcacttcggccgaatggttacagcaattcccgttgacacatctcactgctatggtgcaaattactttagatcataccctaatattgttgcgccaattaggatccgatattacaaagtacagcaggaagaaagaagaaataaacggttcaggacgtttaaaaactctcacaaaaactctctaaaatttttattgaagcctttctgcaccttcaggacgtcatcagctctctagcgcaataaacggttcatcaatcggagttatatagactccagactcataaaaatactgttttagtaggaaacagagtcccaatcaaatctaaaatcatccgtaaccgtccgatcgtgaccgactcgcaccagagctgtccgatcgtacaaaacagtctctgatcatatctgatcaaacttgaaatcatcctcaaccatccgatcatgatcgactgtgatttgggccatcagatcgcacaaaaaagcattgaaccttgcgtgaactgcaacttcggtccatgccggtccaatggaccgccagcaccccacgatccacggtagactacaagcactggcttgggcgacccgcatggtgggccggcccacccatgcgcacccaggtgctgggccatgcacggctgcgcactaggcgcatctctgtcgggccgggcgatgctccgctggtccccactggcctgccatcggccgccgccacctcgtgcaccgtatcgtcttctctcgtgcgtaacttctccgtttggactccatttggattatttttgggcttgttggactctgttttttatccaggaccttactgtgggctcaatatggatcgaattttgagacgtatttcttaacaatctctacctcgatttaatattcgacctccatctatctctgagagcctatgatctcctctccccaatgccttggggcaatcgcctgctgatcatagatggacaaacatgaaagtcaagccaggccgctcgatcccatcttcgtcgtatactgtactctttctgacctgagatctgctcgtagtatcatcctgcagtaatagaaatctcaccttgtgatatcgtctcttatcctctcgagtctcacatctcatgtccaatccatctccatctggagctccatcttactatgggctcctcctagctcttgaagctccaccttgcactgggctccccgtcaggtagtaatgtcctctcgtcctctttttttcttccagaataatcctatcgccgagtaacaccttcaggatttctccaccagctaccgtcctatagcctctcgaatctagtctactcagtgagataagattctgcctgaaatcgaatatatatcggacctccctcaatctcctcactgcatcatcatatgtcctccagctgaccattctgatgcctctgatcgcacagctcgatctatctgatagataaacagtaccctcactgctctccagagagtcaaactgctcctctccgtaatatacatgataggtgcatgcagaatctaaaatctactactcggaagaagtaaatacctcgtcagatatctccagggcatcatcctctgaatcgctactggtcatcgctgcagtaaccctcgtccgatttctgagttgagagtaatctctgactagatgccccaactcgtcatattggtaacatctggtcttactcaaatccctcgtcctaaacttggaccgcccttgtcgtgattttctgttgctctatctatcgcctcctgctcctccacaaatcaccaaagctgagctactgccacctgagttcgaagctgggttctccttcctaagaacctcgttttagagaatcaccgcagtgacctcgtctatcttgatgttgctctttttcactagaagagtagtcatcaaggactcatatgaagggagaagcgacgctagcaagaccagcatcttgatcttcttctcaacttttttgccaacgctgagaaggtcggtgaggatattctggaagtggctgagatactcctgcatgctctgtccctcagtcatccgcaaccgatagaactgcctccagaggaaaagagtattggtgaaagattttgtcatgtacaactcctcgagcttcgaccacagtaccgtcgaggaagtcttgctaagcacatggatcatcacctcatccgttaggtatatgcggatggtacttaccacctacatctatagccatctccaatcctgcacctctatggtggtcggctttttctcacataagagagcatcgatcaacccttggtggataagcacgtccttcactcttgcttgccacaagaaaaaattattctttccatcaaacctgttgatctccaccttgattgtgcttgttttctccatcttctatctcgttcactaccactgcaacctatgctctggcaccattttgctttgatacccattgttgcaccaaccaagattcggtaccataagatgcagtaggaagaaaaaaaaataaaataaaaaatacaatacaaatatgtggatcggcctcaagcctacctcgacaggacgtgcaaacttcactatgagagaataaaatcaatacaagatgaactcatcactcaacctttgtacaagagtctctcaagaaaaaatctcaaaatcttcacaaaagctctctgaaatttttgttgaagcctttttgcacctccaagacgtcactagctctccaatgcaacaaacgattcgtcaatcagagttatatagactccagaatcacaaaaatactattttaataagaaatagagtcccaatcaagtctagaatcatccatgatcgtccgatcataaccgactcacaccagagccgtccgatcgtgcaaaatagtatctgatcacgcctgatcaaactcggaatcgttctcagccgtctgatcgcaaccggctatgatttgggctgtctgatcgtgcaaaaaagcacctgcaccactcgtggaccgcgacttcgatccatgccgatcctatggactgccagcgccccgtggtccacggtggactgtgcgagcactgcctaggcacccgtgcactaggctggcccgcctgctggcgctggaccggcccatgcatgcctgcactgggcccgctcggacattgggccatgtgcgattgcacactaggcacatctccattgggtcgggcgacgctccgctggctgccaccgcttcatgcatcgtgccgtcttctcttgcatgtaacttctccatttggactccgtttggattgtttttgagttttttaaactccgtttttcattctggaccttactttgggctcaatgtgaaccaaatcttgaggtgtattttctaataaatacttctccactcaaacgactcaatgcaaggtaatcaccaaccaacaaacccttccatttcgaaaatttttggcttagtattaaaaggtttgacgacctggtccaacaatggtgaattctggactgagctctcaagaagctgttacttcactaaatctaaagcttcgacaccttcgctctcagctccgatcttggaaccgtacgaaagtaggtaacattataatacaaaaggaggagttaacaaggcaaattgagcaccttgatctagaggaggaacatcgaaccctcacaacgactgaaaatgaggaacgacagggcctaaaaattaagttagacttgctactctctcacgaggaactgctttggcgttagagagcaagggcaaactggcttaaaggtggtaatcgaaatacgaaatttttccatctctgggctagtaacaggagacgaaagaacctaatcctgcagcttcatcaacagcaaacggtgcttactgatcaatgcgaaatccaagacagctttcgacaacacttcaaactattactaggtaatagcacacagcccagtataactgcatattggcatgcattgtacctagaaggtccggttcagctacctgacctggaagcaccattcacagaagatgaagttaaacatgcagtctttcaactggcctcccaaaaatccccaggtcccgatgggtttcctttcgacttttataaacacttctggcaccttatcaaagcagacctacttaacatattccataatttttaccaccatcgtacgaccattgacagacttaactactctttcataacccttatacccaagaaagaggtcaactgtacagctaaagattacaggcccatcagccttatgcatggtatggtaaaaataatttctaaggtattctcacttcggcttgctggtaagttagacatcctcattacttcctcccaatcggcgttcatcaaaacacggacaatttcagatacctttgtaactgcgaaggaaattatcgaacaggccattcataggaaacacaaaggtatcattctcaagctagattttgagaaggctttcgacaatgtagcctggcctctcctttttgaattgctgcatgcccgtggctttggagacagatggtgtaaatgggtctcagacatagtcacaacagctagcgaagtcttcgataccggtcaatggttccatggggaggtatttcactcactgcagagaactgcagcaaggggacctgctttggcctcaactcttcatccttgtagcagatatactaaacaagatcttcaacacagcagcttcgaatggtatgatccagggcattggcgcaaatggtatgattagtccctcaacctacagttcactgatgacacgcttatcttcagtggggctgccaggaagaacatcacatccttgaaattcatcctatactcctatgaactcctcactgggatgaaaatcaatttcgacaagtcgatggtagtgggtcttgggatatctgagatgcaccgcaaccaaatcgcatccattcttggctgtaaaacgggtgtcctcccattcaactatctgggactaccgttacactacaagcgcttaaggcaacaacaacggaatctactaatctagaagatctccaaaaaattagcgacatggaaagaaaaacttctcaccatcgcaggtagattaacactgctcaattcagtggttaccccaaccctttaccattggatgtcagccttcattctaccttccggtatcatcaagaaaattgataggttaaggcgggccttcctttggactggagaagaacaaccaaaacaaggtcgttgtctattaaactggagctcagtctgcaggtcgaaataattcagtgatatgggtgttgtaaaatttgccactctcaatgaggttttgctctgcaaatggtggtggaagttgttaatttaagaaccaacgctccccattatattcactaatccagcaaattactaccatgaccgtcctttttctgtacacatggtgaaccaatgacatctgtcgatgttttgggactcagttttaaaagtcaaacatctatttcagagccttgtcaagtttcgcctgaaaaatggaaaaaatactttgttttggcatgatacatgattattgttataaaattaaggggttatatttaataccctgcagtagaataaatcgacaaaagtgaaactatgtgcaacttgctactatgcaaatatcaaaaataaatttcagcaagcatatatcatagaaaaaaattaagacaccaatatttacatgcttcgatgatcaagaacgatcctcttacatccatggggagagcatcgatgaagatatcactatcaaaaataaaagtacaatgagaagagaccttacaccatcatcgatcgtcttcttggatgaaatcagaggctttatcttcttctcaacaattgcttcaagccaagccaagcaccacaatgcaaaaaaaaaaaaacactttagattcttctcaactcatacctctattcactaatctcctgttcacaaaaaataaaaataaaaataaaaaatcacgtctcaatggtgaccaacggtggagcgaaataatagctgtaaccaactattcatgtatcagttggttgcatggttaggtgggaaagtgtttgagttgatcaagtcaactcaattcttatggaatacgcaacattctccacctttgacgatgatcaaatcatcaccatcagcacagactgtcttccttgactaatacagaagtcttcacaaatattacatcctctatccctagggtctccactcctcaagcagcacaaacattagccaagtcaagacaatacttgaacttgacccctgacaaaggcttcgtcatcatgtcagctacattatcttgagtaggaattttgacaagctgaacacaaccatttgcaatgaactctctaagctggtgattccatacatcaatatgttttgttcttgcatggtaaacaggatcctttgcaagataaatagaactttgactatcacaatgtaatctaacactcttctgatcaatattgagttctttcaccaagccttttagccacactgcctcttagcagcctccactgcagcaatgtattcagcctcgattgttgacaatgctacgatgtcttgcaacatggccttccaactgattgaaccaccacctaaagtaaaaatgtaccttgaagtagatcttcttttatccagatcacctgcataatcagagttaataaaaccaactaaaacattcatgtcaatgttcttctgaaataataaaccaacatctaatgtgcctttcaaatagcataaaatctatttgacagcatcctaatgcttctttcctggatttgtcatatacttgctgaccacactgatagcctgagataaatctgatccagtacagactatgacatacatcagacaacctaccgcacttgcatatgatatcttaagcatctcttgatattctttctctgaacttggacactgctgcaatgataatttaaaatgttgtgctagaggagtactcactgcttttgcctccttcatattaaatttgaccaacactttatcaatgtatcatttctgagtcaatcagagcctgccattatgccgatcacgttggatctccatgccaaaaattttcttagcactttccaaatccttcatctcaaattctgagctaagtttctgtataagcttagaaatttccagcatacttttacaagcaatcaaaatattatcaacataaagcatcaatataataatgaaaccatcagacagaaatttgaagcagacacaactgtcatacctgctccttgtgtagccatgtaccaacatgaaagtatcaaacctcttgtaccactgtcttggagcctgcttcaagccatactgaaatcttttcaacttgcacacaagtttctcactgccaacctcaacaaatccttctggctgcagcacatagatctcctcatttagattaccatgtaaaaaagtagttttttcatctaactgttcaagtttcaagtcccacatagccataactctaatagaacagtgtttcacaatcgaagaaaaaattttatcaaagtcaactctctttttctgtgcaaattccttagctgtactaatctagctttatattttattagttccccaattgatgaagcttctttctttctataaatctacttgcagccaattactttcttacccttgggaagctgaactaactcctaagtttgatttttttttaagagaaacatctcttcttgcatagctttcagccatccattcttttccttactcttcatagcttcctgaaatgaacatgggtcagaagaaacaacaggtaaagcataagcaacagtatcctgaaatcttaatgacttttgaatctatcttctttccctttgccttgcaatagagtaaggttccgcctgtaggtgtacagctggttcctcctgatgtgaagaatcttcctgattaatgtcaccaccaatctcattatctatgcttgacttcatctaaactgaggtactaggcttcttctcatcttgaacctgtttctgaacctctttcaatatagatacttcatcaaaaataatatctttactgagctctaccttcttagtgacaggattccacaacttgtaacttttcaccccaactttatgacctagatagaaacaccgcactgatttagcatccaacttattgcaacaacatataagtaggatagccaaatatatataaatcagaataatctgtaagcttaccagaccaaacctcctgtgatgttttcaagcccaatgaagttgaaggagatatgttgataagatgacatgctgtactcattgccctagcccagaactgtttaggtagatttgcaaacaatcttatgcaacgagctttttcaagcaatattctgttcatcttttcagctaccccatttttctgtgctttctttagaatagtataatgccgaacaatgtcttcctttgcacaaaattctttaaacttatctaagatgtactcaccaccattgtcagtgtgaagacacttgacttgtttctcagtggtcttttcaactgcagcttttcacttcttgaatgtttcaaaaatttttgatttatgcttcaaaaggaaaatccaaatttttctagagaagtcgtctataaaggtgacaaagtaacgagctcctcctagagaagttactggagatgctccccaaacatcaaagtgcacatactctaagatatcattgctcctcttagtagaagtgacaaatttcaccctgcactgtttgccaaacacacatgattcacaaaaaataagttgacaagattttataccttgagcaattttctgttgtgcaactgcaacaaacctcgctcgctcatgtggtcgagcctagcgtgccacagtagagtggcatcattatctgaagaagatgtaactgctacatcacttgtaacagtttttccaattaacgtatatagtgaacttgtcttttctctcttcacacaaccaatgcacctttcttcacctttattactccattagagccactataagagttaccattctcatctaaagtgcccaaggagatgagactttttctcagagtaggaacatgtcttacatttatcaatattctcacaactccatcaaacatcttgatttttacagtttctatcccaataattttgcatatagtatggttacccataagaacactgccaccattaaataaagtatatattgcaaaccagtccctgtgtgaacacatatgataggaacaacctgaatcaagaatccagtcactagagaagtccatactttaggagattgtgagcacatctccttccacctcagaatctgaagcaacactggccttttcagattgtttgttcttctgcttgaacttctcctttagcttggggcaatctttcttccaatgatcttcttgcttgcagtaattataatggttgtctcgtccttttgatttagaacgagaccgaccatgagtcttcttatcatctctgttattctgacatcctctatcttgactagaactctttgctactagaccttcactttcagtaggtttgtctcacttttcatttgacagcagagtcatcttgacctcctccatcagcagtgtatccttgccataaaggattgtagtcaccaaatgatcataggatttagacaaagaagacaacaaaagaagagcctggtcctcttcttccaccttaacctcaacactacgagctgtgtgattaacttgttgaaagtattcatgtgaaccaatatatttgtgccttcaaacatacgcaaactataaagttgctttttttagatggagcttgtttgtgagagtctttgacatatacaaagtttctaactttcccataattctagagtagtctaaatatcagcaacattgtacatcacttcatctgctaaacacaattagattgtactcattgccttcaaatcaagctcttcccaatcatcatctttctttccagatttcttcttaccaagaagggccttatgaagattctgctggaccaatagtgccttaactcttttctgccacagaccaaaatcaatcttgccatcgaatttatctatttcaaattttgcagccatatttgcagcaccaaatgcttgttagaatcacaaaactatgctctgatatccgatgttatgaaattaaggggttatatttaataccctacagcagaatagatcgacaaaagcgaaaccacaagcaatagtgtgcaatctgctactatgcaaatatcaaaaataaatttcagcaagcacacatcacagaaaaaaattaagacaccaatatttacatggttcggagatcaagaacgatcctcctatatacatggggagagcatcgatgaaaatatcactatcaaaaatgaaagtacagcgagaagagaccttacaccatcaccgatcatcttcttggatgaaattagaggctttaccttctcaataattgcttcaagccaagccaagcaccacaaaaaaaaaaaaaaaaaactaactaaagcactctagattcttctcaactcacacctctattcactaatctcctgttcaacaaaaaaaaagtctcaatggcgaccaggtggagcgaaataatagcggtaaccaactattcacgtatcagttggttacatggttaggtgggaaagtgtttgagttgatcaaatcaactcaattctcatggaatacgcaacaggttatatccacaggccatcaaagatcagtttccttgcctattcgcccttgcaaccggggaaaacattttggtagccgaagcctacacttgcattgaatatcttagttacggatttcttaccacttcagccacacatgatagatactttcatagcttgcaacaaaagatgttatctctaaaccgttctaccgatcaagacagggtgcagtggcaatgctttcccaaacaacagttctcaacaagggtttgctataacttcttcatggatggaggagtcagaccatatatcaatcaatttctttggaaaatagaagtccccgagaaagttaagtgcttcctctacctcagctatttgaacaaaattatgatgaaatccaatcttgtcaaacgagggtggaaggttgttgacagtgctcgctctgcgatcacggagcggaaacagcagatcatctcttctgacagtgttctttttctgaagcagtttggttaatactgctgcaggaattccacctcacagagctccctcaaacacagtccaggccgtggactacatggcgtttacagacatgctctcttccttcctaggtaggcttgattcactcttagcaacaacaacatggactttatggaaagaatggaataagcgatgttttgattttcatgcttttatgccatcctttgtggtgaggaatattgataagctattcctctcttggaccgagcatttaccaccacacaaacgacaggaggtcagcacggtttctaaccatttgaagacgctgctcgatctataccagaaccctcaatcaacggcagaccaatcgatctagtcgcaagttctgcaaggaagaactcctcaagtcggtagtcttcactttgaaagaaagatgcttgtaggatgtcaaacagcgggcaattcagaatgattccagtttaatccccaagacacattatcggatcctctgtatgacggtgtgagaatattatgggagatgccgcggtgatatagagatggaagaagatgccgtcaatacaatggtggcgtattcttggtatactatccttcactgctcggtcgatttgtgatttgcgcacagttcttctacgtgcccttcgatgataacacccttacacctcacctagtcgagcccgcacataagtttgtaactcctacagatttttagttttcaatttcctcctctcccccccccacttgcaaacactctctcccacttcatctctgtaaatttcttatatatttaatatatttcagaaggaagctgtttacttccttcttttcatcaaaaaaaatttagaattaatataaaaatcgagatctatatattttgtaggattttaacattttttagatcatttttattagacatatctattttagataaaataattctattaaaaataaaaaaaatctgatctaatttatataaggactgacttcattagtataaataaagattatatattttatttttaatcaatgaaaaaaatagaagagaaaaaaaaacttgaatcttacttttaaaaatttttctcttgctctatttttttttattgaaaattcaaagcaagtggattgaagaattctttttttctccttgatcggctcatggatagtgctgcagtgatactatcttgtttattttatatttaaagataaatcaattaaactacgtaccgatctcatgaaacggagaagacttgaggtccaatcatgtattttatatgatgatgacacgagctgaaagatatggtacatgttaacttttgaccctagttctaattattgctgatatggttgtcaattaataaacattgtgcaaaattttaaagaggatcaatcccaacacatctcccagggatacttaagaagatggattggcttgtggccatccctaaatatggaccattgactgtattgccatctgaataatccaagcttgggctatatgtatataacaagtaatgaatatgtatgctatgcaagagcctaacctgcatttaggtgtcccgcttgctcaaagcatgtgtgcatggcctttagtgcagatgttcgcatatcaacttccatgcggatttgcttcatatagaaattttattcacctgtatattgacaattggcagggcaactatttaccaccactgatcaagattcgatgattgagctttaatacatttcaatcagatattgcagagaccctttgcgcttccactctaacattcaaatctaatcccgacctcacctcggcccaaacctgatagtaaatgagtaaggtatgggcccaaattttgactcatcaacatattcaggtccacggtaggtttgagaattttagattcaacccagcacaaaccttcaaaattacacaatttattttatatttatgtggatatataacattagttttgtttatatatcttttgatttttaaattcttaggttgtgttcggtgcatcgctaggcaattttggaaggtaatgtggattgtcttcaagataaattgttacaactaaattaccagtaatattgactactgtatttggtatatgtaaataatgttgcagtaaaattattaagaatcttaattgatatatttggtatgataatcaaatttttaataatatgaaatcaaaatttcaaaatatcttcataaaattttttgaaattttgaattattgaagaaggaaaggatagcgattggattgtcggaggaaggggtggcggtgattgaggtgagggaggagaggatcgtaaacagagatgatgagagtacaggcaaaggatagacggtcgagggcggcgaaggcacaagggagtttgaagaaggggagggtgagagtagttgggggagggcgtggaggaatggattttgtgtgatttttttttaaagataattttatccaaaattttttttacaatattaccaaataaatgataatttggatagctacttctcctgaagactatctgaattgccttctgagaggcaatttagattgccacctaaaaagcatatcaaacaaagtaatctgatgggcctattttaaattctcgacaatctagatagattgtcagctatcaaatgcaaccttagtatatatcactttactctataacttagaggggcataaagaataaaatgtgatgacaagttagggcatattttgatgtttatactcgattttaaataaagcatatcttttcaattttctaattaatcttgttatataactaatcatcaagtttttgttgcttattatttaattcaacaacatattggatgtttcattgataaaaacctcaagtcatggattgttttagcttgattaattttgttggatatgtgatggatacccaaaagcaatctccacttgtttcaactttgatgtgaattttttgctattggaaccccaatccaacttgatccttcaatagaccaagtatgtcaaagaaacttgttccaaacctaatgggtattaatttaatgaaaactagatttcacatgccccaatagaaccttacaacattatcactaacatagattgatgtgatcgccatctattagaccattaaaagataatggatatgatcaaacttatttataggctgggccaagtagaatttaggttgggcagctcaaggtataactaaatttagtttggtccaggcctggcttgagcaaacctttgggtctaccttccagcgaactaccaggcttcaagctgtaggccgggcttcaagcttcctgaaatgaaccaaacgacaaaagttctttaggataaactagagatgtctgctaagccttccaaggttggtttcgagtcaaagaagtgaaattaaagtccttgccttttccttaccaacgatcacgataaaaatacaaagaagagcttgatactgtgaatccaaaaccataatccccaaaattgaaagagggagaaagagatgggcacacatcaaagcttaccattgactaggaagggagtggagatgtggaaggccttggcctcagtcttcgtaaaaatatatgcatggatccagaggacgtggaggagactggggagaggcagatttcttctcccaatttgagaataagcggtagcccagccaccagcttagccacaagtgaactgcccaccaaccctagcccaccattcaagtgagtcatagttataacaaaatactagtcacgaatttaaaatttccatcaacctgaagatgtgatgccatatcatgatggatcacatccacctcacgggcttcttggacatcccacagtcctatgcattatcagaaatgacacttttgaatttgggccacgggaataggttattcttcacttaatcggaagtggcaaatagaattcaaactaccatataataagcctgttctgtgcgtaatctagtctctagatatatctagagagagagagagagtagaatactacagacagaatagaagccaaactcctagttcacttgcaatgtatagttggatagcaaacagcaagatttcattgaatatatactaattatatttaagaggaatactttggctttgcataaggtcatcacgcaatttgtttgtttcagttgtcccatcaacagcttgccgcataatatatatagctagctaggaattcaaatcatatagttttaagcccacgcaacgccgcatcatacgtatatagctagctagctattcaaatcaaatagttttgagcccgagctagctaggaattcaaatcatatagttttaagcccgcgcgttgcgcacaggttataggacacataatggatcatttttttaaaaatatatttataaataaaaaataatattaatctaaatttttgatgtccatccatattctcaactactgaatttttattacaagaaaataataatatcagactttgaacatcattaagtcaaataagtgagtttcaattcagtcctttaataccatcatactttaattcaatattttaaaaattattaattaggagagtctagacacgtggcatattatcgatagatttgatccaaatgacattcatagatgataatgtgttgcatatgtagataatctaaatgactaatccattttttctcaatttctactttcatattgttgggtataaaatacccacagccgaagtccttagcaaaatctgctcaagtagactccgtccggactcctacgggagccgggctccctcctcaacatcagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatattagatttgtaataggtgacaagcctgcttatttgtcaggcctgggccataccggttgtcgggcttaaatagccaggatcaggcccgcccaaaaagactgggcgggcctttttgggcgggccgccgggacattaacaagtctagacaagatgaaccaactccgtgacctgagcggccatcagatcaatgggttctccgtcaaactgcatccgagccgtccgtgggcacaaactccatcatttaaggccccgtctctcgggactagggttttcctggatgctcggcgaccgcagctagggttctacgaggttcgatccgcttgcctcccctctttttccttttaaactttcctcccctcctcctggatcaccgattgactagggcttttttgatcttttttcagatccggtctttcttctcactactgatttaggtacccttcttcttcgcctcctccattttttgagactttgtggcttttcttccctcttttatcagactttaatcgagtagataatcttcatcaagattgtttcttggtaaaaattttattgtatacgacgggattcttggggtttatcccatctttaatctcatctcgaattgaattaacacgtctatttggccgtttgaggagggcgaggaagttacttggaattgacggtgtcagtagaatgttatgatttcctattatcgtgcccaagaaagcgaatttttaaattgcattgtttgattcaattacagtgcttaacctgataaatgagcatagcgtaattctaattttgtcatcataaatatccatcttatgatacacaatcttcttaattctttaattctcttttatttcttggtttaggtgggtacggatggttgggagaaagaaaaacattttcgaatataacgtttgaatatgaaaagaatggggttatccaaataatagaattcacgacaattggatatcgtatgagaagttgtgctctgttatgaaaatgatgtattgttgtagattaccagagcgtctaacttggaaaagaacggtaattttctttaaaatggagtaaaatacaagactgaatgtggtgcccataagttgttctctgtcgtagaaacatttagtgaaacaaattgaataccatgctttaggatgttgcaatgggatctgtgttgggaaagttcattaatgccgtctttgatcttgagttcctgacccatcctttctgggctaagctttagctggtgaggtgaattatttcctttcacttcaacgagcagcatggtattaatccatactcaaaccttgggaacaatgttttggccaaaacttccaatttggcacagtttcaaatcttgagttcttaatcagcggctgaatactttctcacttgtattttagttttggccaaaactcccaaattggtacagattcagattggttttaaatgaacctgggggtccgagagttctggatgaaacagcaaaaaatgttctttagcctaattgttctggctgaaacaggaaacatgttatctagcctaagtgatgatgttgatccctgaagtagaatctacacatactgatgtttaacgttcttcttcttcaaaatactgcacatgcatcatgatgataatcatcatcaacatcttcgtcctttaaatagtatacatgagtcatttgctccttgggctagagttttatggcagttagctgaagtatgtggatatattttcttccttcttctttggccatcaaatgtaacttcatgtacgaagaaacctgcgacagaatcttgatttatcgtttgatctttctcttaatggttgcaaccactcagtgatctttgcagttaaaacagagttctaatgttgcattgcactttctgaacatataaaatgattttacccttttttttccttttttttttggggttcagtcccatgctttattataataatgtatgagttgtcttttcatccttttaattttagaactctttctgtattttataatttacttattattaaagccttgttctctattttcttgtggcttgtagattttgatatgtgtattatcttttccttttatacattgctttacctatggcttcaattggatcaccaggctttcacgtctcatttcactaggttgagttccttctatctgacctatcagacctactggaaatattcagtttttcaaccactctacaatatgtaatatgatgaccatgtactttagctatgtgatcactgagaactatttttcacatttatgttgctgttgcttgcattaactaaatattatataggtactgtttctagtaatcaaattgctattagtttttctatgatataacagataattgcatggcatgacaaatgacatttgttaaagaggtcactgatttgataaatgatattgattaacttcatttatacttatggtctctgttttgataaatgatattgattaactttatttatacttatgcttttcttgagtagaagaattattttcttcaggcttgtttggatgaatgggctgaaaatcccattgggttcgtggattgggtcagtacaaccagttagatagttggattataggctgagccaggcctataagatctttttttttcttccgataggattcgggctggtccacgttaaaaccattactacctacttatggatataggtgtagcccagtccgtaatcctatctaattgcttgtactagtccaatccatgaatccaatgggattttcagcccattcatccaaacaggcccttaacatgtttattaacttacatggattattttagaacatcttctcaagtttggttagtttcttgctgatttaacatgctgacatacataagagtcatagcagcaaaatgtatacagcaaggaagaaaatccaaaaggaaaaggatgctgaacctactgaatttgaggagacagttgcccaggttagttttgtaaatgtggtgtatagcctttgtaagacatttaatgattttgataaatttgtatagcctttataagacatttaatgattttgataaattttggttttgtcatttttacaggccctttttgacttggagaacaccaatcaggagcttaaaagtgacttgaaggatctttacattaactcagctacgtaaggaaattatttcttgaatccatgtaatctgtgttatgtcattttgagcattgatcattttcactataatttatttttcaatagtcaaattgatgttgccgggaaccggaaagctgttgttatccatgttccttacagactccggaaggctttccggaaaattcatgtgaggctcgtccgggaactggagaagaaattcagtggcaaggtaagaaaatttttgatttttttagtgctttatgcttttcttgattttgtataagctgaaaattagttacaggtgtcagttgtagatatgcttcatctttgtatagttaagcaatgggtgacatgtttttactcattattttgtaggatgtgatattgattgccactagaaggatactgaggccaccaaaaaagggttctgctgtagtacggcctcgaagccgcacgctgacacatgtgcatgaagcaatgttggaggacattgtttatccagcagagattgttgggaaacgtattcgatatcgtcttgatgggtctaagatcatcaaggtatggaggcattccttgcacatttaagtgaatgaaagaaatattcaaatgacagtggttctgttttctctgcatagttcatgcttcaagtcaattcatttcagatattgatttattacacatcacacaatgggttgctttcactttcagtgaaatgcttgtagatgtttttcatttgctaggatttaccatttgtgtttccgatcatttaatatattagcttttagtaaatataaggttaaaatgctatttttaacctggtgaggggataaggcaccaataagcaacccacacagattagattctttggtggcattgaagcaaaactgtgtgtcaaagcatgaaccttatatttgtcattgattgctcatgctgtagcttgaaatgctgttttttacctgctatggcaatctggcaccaataaattattggttatcggtggcattgtagcgatatctggtagcttcaaccttctcctttttttggttattaattagttgagtggattaatggttgtgtggctgtgggtggagtgatattttgaatgttggtgataaatggattatgataatgggtgtggctgtaggggtgttaattccctacgaaaattattagcaaactatatgcgttatatttgacttttgaaaaaataatgggagcatgagttctttgtacctactgtctttattcttgtggctggacgcttctctaaattgtttttggtttccctcctttcgcttttttatttttccctgctgcacgagctgcaccttctcttttgctcctctgagattccttgttctgccttattgaatatcttgtaccatggcagatttttttagacccaaaagagaggaataacaccgagtataagttggagagctttgctggagtatatcgcaaacttacaggaaaaaatgtggtgtttgaatacccggttactgaggcatgaagacatgttgagtaaagcttttcttagactttcttgctttttgtcaaatttgcaacaatttgtgttttaattttgataccgttgctcaaggacaaatttactgagatagagggtatgtttggtggattttggtggggatgactttgggaactcattattttcctagtttttttttttttttaactgtttgagttaaattggatagtgaaagcttgatcgaagtattagctctgatggttgatgttattagcagcttagttatgcttaatcgctttgctgcaactttttcccctagtatgtttctgtctgtgtttgttgagggaatagcatggtggcagttgatgtatccagtgtttgtatctggtgcccttcatttttgatgagtgctttgcgttttgctatgggcttcttgtatgtcacatcctattttgaaaacaaaaatttaaaaaaaaatttgagccgtattaaatatttatttcattattaattatattacgtggctcaatcggatgaagatttttttttcattggaggcagcggacaaaggatttctgtaaaataaaagggccttaatgcagccgtacgattattctattgggatccattggtcttgggtccgagaaatagtctttcatgagagagcaaaattgatccacaaagtaatccacatcaaactttgtgatggtgggagtcttcgtgcaggaagctactttttttactttttttttttttaatcttttgatataagaatcttttaaataccaaaagtaatgttaggtcttaaattacatttcttgcgaagcaaatactaaagttaagttgcaggcccagacatggggtctgctgaatatatgtaggagatgtcaggactactaaaacattagttttagatttttttttttttttgtcataaactagatgctgatacatattttgcagtaaaaaattaaagctattttttggtatgttcaatctaaataagctgctagcaaataataggacttttattattatgcataaatttatcaaaatctcagttttaggagaatttactccttggacttatatgaggatttgactctcttaaaaccattatgctatccttctgtatagaaagatcaacatagttcagatcctcggggagaaattctattgcagttattgaattgcccatttttatatagcgtaatgatgtgaatagtctaacaatgtttaaagttattcagtaaagatatttctaattcaatctcacgtttcaatgtgaaacttcatgtcttaccaccattttggattcgaaactctctccttgtttttttttttgtatccttttgttctatttcatggtttttctaagctgcctactttgccattcaaatatggcaagaactgatcatctttcatccctatgcatatatctagctttgtaaatacgcttcttttttaataaagttggtggcaatggttcacaaccatctgtcttcatcacattttattaaaaaaaaaaaagggaaaaggtcggcatccaggctgaagctctaacccttgtcactgagaactttgctactatgaagttcactcttcaaggcattactattccacctgggtggacaaattatgctaccatggctgatggggaggtggaaagtggaagctcatctatgatagaggttgaagctcccgtaagacttatgagattttcaagcaagcgcattttaatagggatgttggtaggttttttctctttctttcctttttttttttttgttgggagttgctgataaaaaggatctataggcaatgggctgtgtggccattcctaaaacacctcttatcctccaaacctggatgaaggtggggtttgatcccaagcatttggtatagttgtccaagactttactggcttgataaacttttaccgtgaacgggggcattatttaatgaagaaaaaaaggaaaagcatagtcagcgggggccaaatattcttctaaaagtatatttctattccgttttcaagaatactcaacaagtcgagcatcttcgttacttcatccaaatagtgactgcttcaagaattttttggttcatttttagtggaaagctttcattgtcgtgctatgctacttgacaacaccatgattggtccctacaagtaagaaggatccatccccattttgcaggtggctccgctgagtccacgaggttcataatacctaatccatcatctctcttggacatacagaacacctcttggaagaaagaagaagaggacttctttctataaatagcctattccgatcttgccaggctagttaatcagctaggttgaagcagatacttactggtgcccctactaacccccttgttcgttggttaaccctccatcctccacatctagaccaggagaaggtgaacttcaatgcggccatttgtggtgatattgtgggggcggttttgccattaaatattataatggttgtttagctgcaagtggtctccagctctcagagctgcttcagtttcttgtgccaaactaagaggagcatgggtagggctggtcatcgtctggaactcgcaggagggcaggaatatattggtcatcatccctacgtgtgagatttttgctttctaagaagcatggtcattcgattaatgcccatcgtgtctagccgatcaaacactacaaaaaattagatctattgcattcaattttctatcaccggtgatgaacacctgcaaaacagcatcctcacatatcagagttatccgacggagatcctccgatgcttaagtcagagcagaaattggtgaacagtagtaaatttgagtatcgaatgtagcagaactttgaccaaaagtatcttactaatactattttcttaccctttttttgaaaatgaatctgatgtaaccgtcgagtacgtagtcccactttttatgacgctaaattatcggaccacaattgtggagttagtgggttgttaattttcaataattgccgtgacacgtagacgataatcgttcataacagttacagcacgttgagcagattggctgattatatgtcggttatcttggtatgtcgatagaacgtccgagtgaccatcggctagtagttctgatatgttgacggtctcaaatcggagattgttctgctgttggtcggtagtagccgagtatcaattagttcgctgaccatgagtcggtgtcagtcgatgcatagtcggaattgtatgttcagtcagttgacttttattaagccagatgtcaggggttggttgacttgagtcgggggttggttgacttgagtcgggggtcgattgacttaccccagtagttgccttcactcccaagtccaaggagatccgacgtgtgccaccacatgatttgtcacattagatgaagagagtctttttatgtcatatcgaatctcgatttggctgctaacttattcgggatatgagcgtcggctatttttatcatttcgatgagtacaaaatcatcattagattgtcacactgataggatgattcgatgtcggatatcagtatcagatgttgtttcggaaagatgaatcagtgccagacgatataattctgactagtagatctttgccacgtgtccgaatatcattgggtcagagctgttcatacggataatggtgacgtggctcgatctggagtaggtacgttgaactgtccaatcaatgattggcctagatgtcaccacgtgttaatatctagcgagatcttggtgagtgcttcgatcctaaccgttgagggattctatatatatatgattgctttcagccaacttttacttttcatttgtctcttttgctgtggaaactctgccagaggattgttccagcgtctgaagattcttcctttctcgtcttttcttttgagtttcaggttaagtcttctatctttttcgagtcatcattcatctcctttagcctctttcttttcaatggctaggggttcttcttctcagaatggtcggtcggagaatccgactgatgactccctatcgggtctgaaaatggaggcttcttcactttcagaatcgaatgtcgaatggctccagaagcaatatcgcatcccagagcagtatcaactttttgcccctggtgctgatggtcaggtgaatgcccctcctttggaccaggtggctttctatgtcgaagatctttggacgaatctttaattttcgattctgaagttcgtccgaaatattttggactactacagtctctgtcctgctcagctggcactaaattcggtccgactaataatcaattttgctctgttgtatcagttactgccgatcgtacctcatccttctcttttctgtgctttttttatcctccgacctcacccaaaggccaggggttgatggtttttcaacctccgaaaaggtcttttttcattaccgatcttccatcatccatccatgggtggaagaactagtttttttttgcttcttccactctttcttggggctttccttctcactggagcgatccaagaatcgatcccaacgataacagtaggatggaggtcgacgatcgggagaacttctatcggctgaaggatattgtagttccatcgtagagagagcttatgatcgaacaggctctctatgatgtcggccttagttcgatcgccaacttaggtatagtatagccggtcatttccaactttattcctcctttgtttctggattgtgttaacttttgttctaattgcagccatgcagtcgagggcgcgagtgtcacttgtcgatgttcgtcaatacgctgtcaggaagaggacagcatctgaggctggacctttccgaccattgaagaagagtcgagttgcagcttcggtgcagattctagttactgcttcaacgcaagctccagctgctgcttcaacgtcgggtctagttgttgctttgatgcaagctcgagctgctgcttcaatgccgattgaggaatccaaggtaccgtcggttcctaagctgatcctggtgctatcaacctcgacagcacttctcactgcgccatccgcaaatgggtggcgagagaaagaactactgcagcagagtcggtagctccatcatctgaggaggttcgggccgaggtggaggttacggtcgaacccaagcaatcagcgactgcgtcggttgctcctttggcaagggtttatctgatgcaatctagttcaagtttttctatgttttcaaatgtggggctgctgacacgagatcgaggaaaagctttgatgacttcgacgaacgatgcagcatcgaagagccacacagtccattttaaccttgtggtgtctagagatgagtcagctttggtcaatacgacattggccaagcagcttctccatgccgctattctcccgactgatcgagagagtcgaagaaaaaagatggtggctgagatgttctcatctttctattcgatgatagtcagggtaagttattttactcctttcatttcttatatatatatatatatatatatatatatatatatatattattagtacgtccgnnnnnnnnnnnnnnnnnnnnttacttatatatatatatatatatatatatatatatatatatatatatttgatccgactcatcttctgtttacagttgatctatgacatgtctgctttgaaagtcggctatgagaaatttggcgactttcgtcggtcgtagatgaataaagtggcggtcgtcgatgctgagaaggcggctgcctttaaataatttaagtcggcagctgagtggaaggtcaagcttcggcaaaagatctttcgattgactgacgacttagaatcttttgaagccgaacttgagtcagttcgtcaaaatattttggctcttgagttgaagatcaagagcaagaaacactccatccaccagcttcgacgggaacgagatggatgtattgccaaactcgaagtcgaacgtgtatgacatcaggccagtctagaaagattggcactggctgaagaagagtcgtcttctacatgagtcgatgctgagttggcacgagctgatactaagctggtgaaggtggaagtggagttagcgagggaggcgttaagttgagccatcgaggacttcaaggattcaaaaaaattcaaaaaagagatccttaaaggtggattcatctcttattgcatcagatatgaaaacggtcgagatacagtcagaaaattatatccgaacctcaacttgagcagcatcgttcctccagaatcgaaagatggagctgctgaagaagatgcagtgtcgactgaaagaagaacaccaacaccaccatcactagaagttgtccaaatctccgaagctactccagagcaaagagataaagacggcgatgaagtttgatcgatgtagttttatttttttttgtaatcagatacttgtaatcgaacttcggtccaattttgtaacctcttcataatgaatgaaaagaatttttttaagttaagatttctgtttaattgtgcttgtctgcaatgcaaattatttaactaccgaacattaatcgacgaaccaatcattcgatagaaacttgttgaatcacttgttagtcgcgtagttcttttttacgtactttaagaattaagataaacgataataagtcaaataccctaagtccaacgattaatcgatttgtacatcatgtcatttgataattgatggcaagtcgaatatccttcgactggccatagccaagtcagtataatttcaatccgaccttgatcatattggcataatattttgcttaggtaagactaagtcgacatttagtctttcgactatgatcggcttttacagtaaaaatcaaaatatatttagtaccaagacatagtcatgctcgatttttacaatgaaaattcggtgtaattaatgtcaatttttacagtgaaaaattgagataaattatgtattgaagtatagtcaatagtttgacttttacagtgaaagccaacatatagtcgatgattgatggaagtcaatcaaaatttatgattttgaaattctgaaattttgtattttattttgaacaatatgtacatgggtgattttattgatgatacatctttaaattgtcggcattttatgtttggagaatagccgacccttcaagtgtttccagtcgatatgcgtccaatctaagtatttcagctattctgtaagatcttttccaatttaaaaataatttttcttaatctaaaagtttcaagacttctacttttcttaagaccaagtctcctgatcgaagaccttcaatttgacttttgcattatagtatcggattactctttgctgatatgtagctatccgaacttaagcttgctgtcggacttctaggagtagatctaaatcagctctccgatatttaaaattactcgactcactatattgttcgatccttgttgatggcaatccgatctcgagcgagatcatcgcttctattccgtaggtcaaattgaatggcgactctcccatcagtatgcgagaagttgttcggtatggccataagatcggatataattcttttacccagagatctttagcttcattcagtcggatcttaagtccatgcaaaattgttcggttggttacctccatctctctatttgattatggatgatcgactgagatgagtttatgcataatatgaaattacgcatagaactttttgaaattctaattatcaaattgctaaccattattagtgatgatgatgtgtggcaaatcgaatctatatatgattgatttatgaatgaagtcttccatcttactttcaataatttgtgttagagattcagcttctatccatttggtgaagtagtcgatagcaaccacaataaattttttctgatcagatgtcagagtaaaaagatcgagtatgtcaactctccactgtgcgaagggtcatggtacaacaattgatgtaagctggctggtcgattggtgctggatatttgcatatttttgacatggttcacaccttcagacgagctcaactgtatctttcttcatggtggaccaataatatctttgtcgcaagattttgtaggctaatgatttactccctaagtgatttctgtaaattttttcgtaaacttcttgaagtgcgtagtcggcatctgttggtcccaaatactttagtaaagaaagagagaacgatcttttgtagagatgatcattcatcatagtatattgagatgccgttcatcgaagtcgtttggcttctgagggattcataggaagagtcccacttgttaagtactggacgatcagatccatccagcttgattcaacagtgagctgtaatacctcctcaaccttgtcgatactcgactattcgagacattcaacgaatgtccgacccagtgagttgaaagaagtagtagcaagtcgagagagtatgttggcttgagcatttttagttcttgaaatatgaaagatctcaaagtattttaaggttgatataagatccttcactttgtgaagatacttcatcatgattggatctcgagtttcaaattcatctttgatctgtccaacaattaattatgaatcggtgaagaccttcaaactatcgatgtcaagtttctttgcgatcttcaagccggctaagagtgcttcatattcggcttgattattcgatgctttgaagttgaactgaatggcatattcagtgaccactccttcgaaatttgtaagaatgaaacctgctccactgccctgtgcattaaatgctccatcaatatgcagcatccaaatcgactttaggtcgggttcgggagtcacggtctgctttattgtattatcagtttcattctctagtttattattggatattgtacattcgacgatgaagtcggctagaacttacgcctttattaacggatgtgggcaatattgtatgttgaatttgtcaagttttactatccactttgtcattcgactcgaagtatcagatcgatgcaagattgccttcaacggctaatcggtcaagaccacaatcgggtgtgcttagaagtatgggcgaagccattgcaatgatataatcagagcgtagatcatcttctccgctcttgaatacctcacttcgacattatgtaacactttgctggtgtagtagatcgatcgttggattcaattttcatcttcttggacaagcaccgaactgactgcttcagtcgaagttgtcaaatagaaatacagtatttctccacctttgattttatgagcaaagataaagaggtcaagtattttttcaagtcttcaaaggactgtcggcattcatccgcccataagaagtccttcgtttgccacaaaatcttaaaaaaaggcaaacatctttcaatcgacctagaaatgaatcggctgagcacggtgactcttccattaacttgctatatctcctttttggagctcgggtgcttcatattgatgatagtttttatcttttcgagattagcctctattcctcattatgatataagaaattcaaaaaatttttaagaagtcaccccgaacacacacttagttggattcaactttatctggtatcgtcgaagtgtgctaaaggcttcttccagatcctgaacatgctctgaagcttgaaagtttttcaccagcatgtcgtccatatatacctccatgtttcgttcgatttgtgctttgaagattttattgataagccattggtaggtggctccaatatttttcaaaccgaaaggcatcactttataacagtatatgcctttatcggttatgaaggctatgtgctcctcgtctttaggtgccatttgaatttgattatattcaatgaaggcatccatgaagcttaaaagttgatgatctgaagttgcatcaaccagttggtcaatcttcagtaatggaaagctatcctttggacaagcttcattcaaatctgtgtagttgatgcagatcctccatattttattggccttcctcaccattatcatattggcaagccagtcgggataagtagcttctttaatgaagcctgctgcaaggaggttgtcgacctcttcgtcaatggccttctgtcttttgggggtaaaagatcattttttctgtttctctggtttgacatttagattgatgttgagtcggtgagttattacatccggagggatgcctggcatgttggtggccgatcaagcaaagatgtcggcatttactcttagtagatttattaattgctgttactccggatcaaacagctgtgatccaatttagactgtcttttctaaatcttcttcttttagtgggataaaaatcagttgctcagccgattcatccctttcctgattctctctttggtccaacttatcgatgggtagagagtcttcagatttattattttgagtggagactaagaagcagcatcggactaaactgttggtcttcatgcatttcttcgactctattttttgtcgaaaatcggaccaataaatggtatgttgagaccaccgctctcaatgcattacggctagatcatccgagtatgacattatagaccgaagaaactcagacaaccatgaatgtcacaaaaatagtgctctgcagtggttcagttttcacggttaaggggagagaaatttctccttccacagtcacaatatctccagtaaaaccaaccaatggcgtcgagactcttctgagtcgatcaaccagtagttgcatttgagagaaagtcgagtaaaaaagaacatcagtcgaactttcattatctacaagaattttttttacattataatttgctattattgtcgaaataacaacagcatcattatagggagtttgaattcttcgaacatcctctttcgaaaagttattacatcattgagtcgtcaccttttcaccgactctttttcaaaagttgtcacccagttcgatcgtccggagatcatattgattactcctacagtcgactgactattgatagcctcctcagtttgcgactgaggtcatcggtcggcaggaggttgagtcggcggatctcctcggtacttctcgagatagcctcgtcggatcaaggtctctatcttgtccctaagctagatgtattgttcggtatcgtgatcatgatcacgatggaaccaatagtacttccttcgattacgattcctcgagggcaccttcatcggtggggggtatcataggtactctgctctttcgatctccatgagaatttgcgcatgaagagcagagagagaagtataggagtcatatctatcgtggttcgattttgggccgtagtttggtttcggactccatcgttgaggtgaacttgcttattagagggtggccaacttgattcggttggagctccacctttcttctgtttcttctgtttcttctgcgcggatgtacttgtatgcacattcaagaagtttaacgtaggtccaggagagagtttcgtccaaagagtaggagaatctggatctcctcagacccctcttcatggtcgatatggccatatcttcattgaggtccctaacctcaagtgtggccatattgaaatggaccataaagtttcttaaagtctcagtctctccttgtatgattgagaagagactattggatgttcgtggtggccttcggctagtactgaagtaagccacgaaagaatgttcgagctactcgaaagaatcgatgcttcctgactgaagcccggaataccaggcccgagtagcttttcgaagggttatcgggaagccaatgcataagagggtatcggttgccccctggatcatcataagagctttatagctttctaggtggtcaattgggtcggtggagccatcatatgcttccacctgtggcatcttgaatcgagacgggatccgctcgtccaagatatgccgagagagagattggacagtgtgaaagtcgtagtcactagaagatttctaacctttaatctgaagccgggcaagtcggtgctcgattttctgaaacttgcgttcatagtcgtccaaccaccattatcggaagactccataggtagaattttctaacgaatttgaaggagaagcagaaggtatccgtggtcgtttccccttcctaacactgtggagacagaaaagagaaggggaacaccgcgagtagtgggtggcacagtgagagtgctgagaatgtgatcatccgtctcggtgggaatgtcgagacggtcgcttcgaggagaaaaaaggtgatcgtcgtggataacggtggctgtaactggaaggcactgactgtgccaccggttgttccgccggcggctgctactgttgttggaggcttttaacagtctctgtcaaaatattcatctgctgcacaagtgcagcgatctgagcgtctatgataaccacgggatgagaggaactaggctctgctaccagaggtgggggaggaggatcttcccgacgggaagagtgcctcaccgaactggttgaaagttgggctctggttttcggtatgattgattacagatttttcttctcgtatctaatgtgccaatctgttgcggccaattctctgtctcctatcgccagtgataagtacttgcaaaacagcatcctcacagaccggagttgtgtccgacggagatccttcgatacttaagttagagcgaaaattggtgaacagtagtagatttaagtatcgagtgtaacagagctctgaccagaagtgtcttatcagtattattctcttatcctccttttatagatgaatctgatgtaaccgtcgagcacgtgatctcattttttatggcactaaattatcgggccataattatggagttagtggattattaattttcagtaattgtcatgatatgtagttgataaccgttcataattcttacaacacgttgagtagattggtcgacaatatatcggttatcttggtatgtcgatagaacatccgagtgaccatcagctagtagttctaatatatcgacggtctcaagtcggagattgttctgttgttggtcggtagtagtcaagtgtcaatcagttcgccgaccatgagtcggtgtcagtcgatgcatagtcagagttgtacattcggtcggttgatttttattaagtcgaatgtcggaggttggttgacttgagtcagagatcgattaacttaccccaacaagaccaatagagacagcaaaatccatctctaaaaaatgaaaatctatctttaaaaagtatttgaaacgaaagttctctctttgatagttgtctctgcaagtcgcatcgctaaagcaattagagatggacctatcaagatggctttttcagagacaactatcccatcgctgcaccatctctaaagatagccgtttctaatgtgatttattttaaattttttaatcaccatctctaatgattgtcgtctcgaaatcgatctttattttatttcttttctgtctctaatcttaaaattatttaattaatttaaataatactattcatattatatttatattaattataactaaatctaattttgtatagatcaactaattattaactgtaattaaataaaaattatttttgaattactaattaatcatataatttttttaatttctaagaaattaagatgttctgaaagcatcggaaagatgctttccaacaatccaagaccagtcgatcgtgtccttggcgacatggctggtgacgagtagtggagatgcctttagcccttccttggttgtcttagtcgacagtagccgttagttgccagaccttcaagtagagcaggcagcatcgaagaggatcgcatggctcgaccacatcagcccccttgccacagtcgtcagcggcatcggtctcatcctccctgatatgatcgatgtcgaacacttccctggctgactggcatcgacagtggccctcagtcgctgagccttcatgtggagtgggcatccatcagagatgatcgtgcggctccaccgcatccgtcccctctctacagttgccagcactcagtcgacgtcgatctcatcctccccgacatcaccgacgtcgaacctttccttggtcggccgccgtcgatggtggccctcgattgccgggccttcacgtggagcggacatccatcggagaggatcgacgtcgatctcatcctcctcgacatcaccggcatcgaatccttctttggccggctggtgttgatggtggacctcgattaccgagccttcacgtggagtgggcatctatcggagagaatcgtgttactccattacgtctacaccctcaccacggcctctagaagcttcgaggagaagaaatagtggggtcgggtagcatgcttttttttttttggtaaacctagctagcgcacggctagtattggtttctatttaccatggctactggagacggctatgctggtttctcgtcagagatagctaaatcatctctgaaaatttatttattttttaaatctttcatcgttatgccatctctgaaagttctgccgtctccaatccgtctctagtactcaattaacataaaaaaattaatctctgtctttaggccatctcagttgatcatcgcaggaaagcaccatcttcaaactgtctctacgccgtctctgaaaatgaatttctgagactgctttttagctgttccaaatgaaccgcctctaaagttatatatatatatttttatttttattttatttaatttttttgtagcggaaagatatgctccaactattttttcttttttattatttttggacatggatgactaacataaatattctcaaaatatgattaacatactaaaggaaaataacaaagctaacgttcctgtttttatggtaacacatggctgcggctagctaccatgtgggagtataccacctcagactgagtcccacaaaatccccacgataatcatcaggacaaggaagtgtctgtaaacgccgatcttccaatgagaatacctggacaacgtctcccatccctctgttgcaataatagatgcaattacctcgaagacctgttccagtgacatccttcgtagagaaagaatccaacccaccgtcaaggcccaacaataacgctcgatcacctaagttctcgatccgaatccaccggtcgacgtccagcttatagatgctgcaccccgagatctcccgccggtaatcgcctaggaagagcaggagctccccatccgattcagccattctcaaagtatcgacatcgccaacaggaagcgctatcgaaaatttcaatctcggctggggatcgaaagtgtagaccctcaccttccccgtgatgtcaagggcgtatagttcgcccttgcagaataccaacttcgggtgaatccttgcttggcgatagaaaacggtccatctctgctcttgtcccggtctgcagaacgccaaggtggaagaatgccccattgcaactactgctgcgacgacgacgcagtcaggggaagtgggaggcgaggacagaacggcttctgagagaaagccggctggaaacatcggtttgattttccggcggttgtattccgtcgggagatagattcgccgacgtgtgacggggttgaacagaaagtatccgtgggatcctcctcctgaggccgaaaggaggagccatcccgtggaagctccgtggaaccacacgttgctgccaattcgctgggacaacggtagatcaactgagaccttgcggaaggtgccttcgtggaggctgaagaaactcggtgcatagggagagacgtggcggctccgcattgctagccacagcagcggcggagggcgattctgggcagccacggacagccattctttgcagactccggcgaaccggaagtggtcggcgagcgatagacgcagaaggatcgactggagtaggtctttgggcagtccggaccagcataacattgctttggggcttcctgaacgatggagaaggaacggaaactgatcacgaagttgtgaggacgagcatggaaggcggtggccatgagttcgaggagtagtagaagagcggcagagggccttgtaattggttcgggggtctccctccatgttcggtgttttggtttggagactggtcgcggagcggacaatataaattatagccgaaaggcgaggcagaatcctggtgtgagtggaattctgtcgcgattggtcttcataaaagccatagaaatcgactctaattaatagatgatattataatttaaataaaaaattaaaaaaaatgatgctgtaattaccacacaatgttactattggagatttcgatttcgtttaagaaaaaaatgcaaatttttaaataaaatttttaattattttttgttttgaaattttaatttgtttcagattcattttcataagccaattggacttcaagataatgggcggggcagtgaaaaaagtgtattaggttaaacctttatgtgctcgtgataaagagatttctatctgaattgaatttattgtttaatgaagacaatgtgtcataagcctaatacctttctcttatattacttttgtaatttttcttaaaattatttataaattttttttctgtatttattagcgatttggatgatgtagcaatcaacaactatgactatataatcataattaagaaatctaagttattacaaaaaaatagcctaattaagttcggactacttttagcttgaaaaaaatattatgagaaaggctagccaagagaaattatatgaattttgttgatctagtattaaaatcttccaagcatatatctaatggaattaaatatgaatttagaacctcatccataaagatcagtcagaaaatattatttaaattttttgatcctatataagtatctaaaattttctttatgtataatcattataagactaatacatgactgaatggatccacacactaataaacagataaaagggtcacatagaatttaaatgaatctgatttttctttttttttaaaaaatatgatataattagagaagaagtgctatggtatccatatataagaataaataggatgtacaaaatgatttcaattattagataattaagtttatgaatctctatgaaattatgaaaaaaggtaattgaacgaagattgaaaaagtgataatagatatagtcatttttaattagatatttaataaaaaaatatagagaaaaagaatagtctataggctttatgaagaaataatactaagaaagataatttgatggattttaagaagaaagcatgcatataattggtgtgctaaaataatttaggatatttttattgaggtataagtgttagaagttgctgcaatatgataattgcatttctagttatcaaaagcttgtatcaagtatcaatattaaatttacatcattttgcactaatcataaataaatttattgctaatttttagaaaaatatgtcatggtatatattatttatagatgttgtggtattgattgatgaaaagacaactaaagtaattacttggatacataagaaaaaacttttgaggatggggatttaaagattagtgaaataaaaacagagtatatgaaatataaatttaaaaaattaaaatgaagatgtgatcccaattaggactgataattataagatattatagagtgataaattttattatcaggacctattatagaaaataataaaagatatataagtatataatagaacgagagtagggctggcaaaatatgatttgatctgccaacctgatctatattcgacctgtaataaatagatttaaatttaagctaaacaggtttgagttataaaccaatcgatccgtttaacccgtttaataattcgatcgaatttgaattttagatatctgacccgtttaacttgtttaacccatttaatattcaaatcgggttgagtcagataatctatttaacctgtttaatctatttctgacctatttaaccagacctgtttaacctatttaacccatttaagatccgtttaacttgtttaaaatatatttaacctgtttctgacctatttaatttaacctgtttaacccgtttaacctaatttgatctatttaataaatgaattaaacggatcagattgggttacatgtttaataaatagatcggatttaggtttgaatttttgatatgtttaataaatagatcagatttggattgatgattttctgatccgacccgcattaatctgatctgtttgacccaatccgacctgattaccacctcttaacaagagctggttggatgaagagaaaagctgaatttaaaatattatataatatgcagatacatcatacttcaaataaaattttacaaaataacagtaaattttgttatgttagataacttaagagtattagataagagagaagtacataaaaacaaattaaatacagtagatatcaggatggatacatagtaaaactagaaataataaaataaaaatgaatatattagttgagttgcttggtgcaaaatgaaggataaaatgatggtaattcgttatttgcggaggctttaaacgggaatatgttgtgaatatggatctagactaatctaaaataattggaaaaaggctaaacagtggtggctatgattcaagttcaggtggatttctacaaacactaatgactataattctgaaaaacttgctccaaagaaaccctactgaggaaatccatgtttgcatggttactagcatttagattaattctggcttaagagaggcattattacataaaacttgataaagatgttggctttgagctttggtacgattacttaaacaaaagataaaaataattattacaagagaatcttatagtgtctatctagatggcaatttctgaattgccaaccgatccgatccggatctacttgcccatcatgttgcggattagatagggttagccaatcctgtttgagtcgaggcccctccctagatatttgaaaaattatgtactgtattaatcatttgactttattggcttagaacccaaaggagagataaattttagcatacataattcaaaaattataaaaagaatttggctgttgtatcagccatttctcccttgctggtgagtagtggggagaaattattgtctggaccatgcccacgtagaccatccaaatcctatgatggataacatgccacattaacccttatatttcatgaattcctgattgcgtattatccaccattcatatgctctaagattatgctatgagatttgtgctgatctatcaagatgttgtccagacaataatttcatgttgcttgagtaatatcttataaaagattttttttaaaaataatatttattaataaaatatgctgaaaatatggtggttcgaaaattattttcgaaactaccattttaccgccatctcaattcaaatcgtgagttgaactcatgatttcaaatctgcatgaccatcagatgtggaccaaaaaaattgaaatcatggactcaacccatgattttattaaagtcgtaggttgagctcatgatttctttttttttcatcgtttccccttctccctcctttttttttctttattttttcttttcccacgcacggccacccttcattttttttccactctgctctaccgagggtgtggatggaaaggcgtgagcggttgtcgatgcttgtacggagccgtaaggactcaaatttatcggagccagggaaaaaatgagaggggacagtggtaggatggggccacgaaaggtgcaggaggcagttgcatggggtgcggaaggcgcgagaggcgcccagggccaggaaggagaggcatggggggttcatagtgctggagccaggagagagaaggggaggaggtttggtggtcgtgcggagctgggtgcggctcaaatgatgagtgtagcacgaacggcggtgggacggagccgtagtgggggtggcataaacagccgcagcctggggctcacgcaatggaggggcggaggcgacgggaggaaggaaaggaaaaagaaggaaaaaaatatatagagagggagagaaaaaaatattattattttattattaataataatttaaaatattatttttaaataataataaagtcgtattttaaaagattaaaaaaataatatcttaaaaaataaaagtaggagagggataagagacaaaacaatattttttaaaaaataaaatattataaaaataataatatttttttaaaaatattaatttattattattaaaaataataatatattattttttaattttaaaaatatactaatgataaagtatgtcgcattttgttctctccgcccctccctttgaatttttatttccctcgatttggggggatgggggtaatggaactaagcccttttgtcctctatttacactcgtaccgattattagtactccctcgctcgctcaattccgccgtccgccctttgctcgcccatgatgcctcaccatcatcctccgataaagaaaaatagaaaagcccgtggatcctctgcttatatattctctttttatataatattttattattaataaaataataatattttattattattataataataatttattattaattaaataataatattttattattaatcaaaaaataattatttttaaataataatattttaatattttaaataaataattaaaatatttattttttaaaattaatatttttattttaaattaataataataataaaataataatattttcnnnnnnnnnnnnnnnnnnnnttttattttaaattaataataataataaaataataatatttttctttcttcttttcaaatatttttttcttctttttcttcatattattattttttgattgataataaaatattattgtttgattaataataaagtaatattttagtagtaataataaaatattatataaaaagagtaatgtataagtggaggatctacagacttttctatctctcttggctggaagggggtggtggcaggggcatcataggtgagtaagaggtggatggcagaattgagcgagcgaggaagtactaacaattgacatgaatgcagatagaagacggagggggcggaggatggaagggctcagtttcgtcctccccctcccccccacaactgagggagatagaaattcaaagaaaggggcagggagaacgaaaaacgacatattccatcattagtatatttttaaaattaaaaaaaataatatattattattttttaataataataaattaatattttttaaaaatattattttttatttttataatattttatttttttaaattttttttaaaaaatattattttcatctcttatccctcccttatttttattttttttagatattacttttttctaacttttaaaatattactttattattatgtaaaaataatattttaaattattattaataataaaataataatatttttttcctctccctccctaattttttttcctctttccttcccttctcttcctcccgttgcctccctcccaccccctctcgtcgcgtgaggcccaggccgttcgtaccacctccgttgcggccctaccccaccaccatccataccgcacccgtcgtccatgccgaccaccaaaccccctccctcgatttcgatgccaccaactcccctcctctccctcggttccggtgccaccaaccccccttacctcccctctccaacctcgggcgcctctcgtgactcccacactccgcgcgactgccttttgtaccttctgcggcctcgtcccactgtcgtcccctctccttccctccctcggctccgaccaatctaaggctccgcagtttcatgcgggtatcggcaaccacctgtgcccctccatctgtgctccttggtaaagtagagcggaaaaaaaatgaagggcggccgtgcataggaaaaaaaaaaaggggaaggagaaatgaggaaaaaaaaatcgtgggcttagctcatgattgtagtaaaactgttggttgaatctatgattttaaatttttttttgctccatattaagtggctatgtaaaaatcatggattgaactcatgatttcagctgagatggtagtttagaaaataatttttgaaccaccgtttttttaaaatattttattaaaaaaatattacttaaaaaaaatccccctgcaagttttgaaatctagggtcgaccctatccgtacttggcttcacgtgctcattgatacccttatgtctacaagtcacgtactccttgggtttgagctagttgttgtgtctggcacgctagctcaaaatcaatatacagtttactcgtcatagaatgtaaaattttcatataagtctccactcaccgctggagccactccagtcgcttagcaatacaccccgcacccatattagctcatgagggaaaaccataactaacacgcaacataaaaaaaatactcacggggaagtacttaggcgcaggcctggttcattaaataaatgtacttctaattgggttcgaaggtccaacacgatacccgtctgcctcttcctcttgccggccgagcccgtcgcatgctcgcctcctccgtcgtcgcgtccctttcgcccctcgccccaaaagagagcccgtcctcctcccaaccctcgtggaatttatcggtgattcgctgaagttgatcgagggatcggagatgggttctcccgagaactccaactgggtctttgattgccctctgatcgacgacatgtccgttgccggaggcgatttcccggcgcccgggaccggattctactggactccccagggaatcaacagtacctccaattccaggtatgccagattgcgttcttgatggcttcttgctactgccaattcggttcttcttgttatagggtttcctggatcgagccctggtcttctttataaaccaaaaaatcaacattttttgatggtgattatcatttatttgatgggatatgtggtttttttaatcccagctcgttgtttttctatgcctaatgtcgtattacttgccactaacggccggagatgctctccataattagggttttctgtaattcatgatgtgactccaacttcttttgctatctttggttctcatgattcttggaaagtgatatattcagtaacattaggtttcttgaccataaacgaatgtatgcaccacaatcagatcttctctagtttaaattgatgcaggatcataagaggaatgttccaagtagttgcctttgaagttcagattgacaattcattaacgatttttcagttatcattggtctgcattgcttatgtgattagccatcctctatatgttctaattatgctgctatagcccttttgcaatctatgaatgggtcatcctgcttttaatttattttaacctggtagggggcatagtcctatcaaacaatatcaatacgctgatgttacgttgaatttttatgggtagctatgagactcctttgcattatttttaaatgacttattggtcaagcttaatttagaagatttcgtaagtggtgtcatgatggatgctttttatgttttagtagaaagaaaacatatggaacatgtcctttaggtcttcctttaggcattgccaagctgacctctgattggattattttggtgtatggattaactggaggttggctaagtattagagaaattgtcttttcttttctttttatattgtttcttttccctttttttggcagtggctagtattcttaacaatgtttgccatgaatagttgcctaatgcatatgtatatccatgttctatattgtttagttagtagctaagaagtaggcaaaaattttgaggaggtttacagatgatggaggaggtgtgatattgcaattcgcaagtggagcttgggtagtcaacttaatttatatccagcatttaaagatttgagctggagatgagacttacagagtgactaatgacctttgtgttaggctttggagataccatctagtgttgaaagttatgatgtgtctggaaatattttccttaagtttctctcttttccttgttaaatgctttttcgctttttctagtaaaaagaggccctgatttgagaatctgaatcaaggtgattgtagagttttgaattatgtcctatggtagcatgtttgaggtgggagattggtgtccttggatctatcttggttactgcaagttggaggcagtgcttatggttggatggtttcttcggttaacatgttttgcttgtacaaaccttttaatgcatagagctggaacatagactgaagagtgggtattgggatctgaattaggattggataatagcctaggtgctagactggtgcttgctgtgggaagcaccattatggagtgcattgtccctgatacctttgctgttattcctaacagaaaggctccttgatctaacaatctgctagctaaaaaaaaagaaaaagaaattcaaatattttcactttggaaagtgttgtaaagtcaatatcagtacttgcatttggtggtctttgagactagagactcttggtaactaatttctgaaaacctgcacgttgcttgttgcatagtaacttgggctatttaacaatattgctatggacatatacataagcaaaaaaaggtttggatcaggaccctagggtctcttggaatacccaagtgagattttctagccaattttttgtattttcatctgcatgcttctcctaaagaaagggtagtaagaaatgctagaaaacgtattatttatagttcgtttactatagggaaaatattggatatcataaactatttataaatccttgtagtatgttgtcaatgttgctcattttgctatgatcacattttcatattatccgagctttgagtgttacatgtttttatatattgcttgcaatacctgggtgtctttgtttgtcttaccaaataaaattgctcttttcattttggaaatgttgtgtcttatttgaagatatagtttttcctatgctaaatttcatacatttagatttttttttatttttttttttgtcactgtgctttcattttggtgttctttaggattgtcctatttttgtgacacacacatatattttttttggtcagtgtggaaattagtggctcctttgtagattctgctggcattaatgagtcaggctccaagaaacggtttgatttatacactatgagctcataatgtcgagttaaaatgtttttttaagctgttagtttatttggtctgaagctactaagcatttctgagtaacagtgttaggtcagaatcttccagtcagcccggctccaaagcctgcagggaaaaaatgagacgagataagttgaataataggtatacatgctgccttatacaaatcttatgatgtgttttaaatacttgatagtttcttaagacttcattagttttattgcgagctttcttaacttcggcttgattataaggttcttggagttgggatccattttggagcctggaaaaccgccgaagatggacaaagcagctatcttaagtgatgctgtccgcatggtgactcaattacgcagtgaagcacaaaagctgaaagattcaaatgaggatctgcaggagaagatcaaagaattgaaggtccattttaatttatctttcatatacttccttatatctatgaccaaggtgtttgaactataaattgtttctttgagaaatctagccagatatatatatatattttttatatgttaccaacatattcatgtctgttatatggcatgaacataaagtcttttactgtattatatagtcttttactatgcatgcatttcataccatgatgtttggctcctggtgtgatttctttattgttatatgtgtctagataggctgtgatgagatagaacatgcttaagatttatggtatctgagcttgggatttaaattgtgtgtcatccactttgaatgcctctctctgagattggcttatcctttttcaatgtctacattggtttggatgttcatttaattgattatgcgttactgttttgccattgacaaggttaatattattgactgactgttgaattttgtgattaagatgaaggaattttgttgaagccttttgacattagatggtattacaagggtttatatgttatcttgaaggctattcaatgtcttgcactgcacctgccttcatctctataactagacacgaccaacttttcttgttttaaactagttttagcgaccaaagaactattgttgttttttatccaactgtcttaaatcagattacatgagtagtttaattggggcaccttagtttcggttgaatctcactttcatacttgttcagtttttaatatctttatcaagattgaccaaatgtaattatttgtattgactgagctctttgtgacaatctgattcattatcatttcccagatttttttgtacttgtttcctcttatatttttaatgatgttttttcaacatttaagtgttaagttttaattctacaacacaacggttagttttttcccccttttggttccattatctgctagacatgtgaccatcctattcaaaaccatatggaaaattacacagggtttagggaaaaatataatagcaagaccacattataaatttactatcattaggccttttaaaataatcttacaaaaaaataagatactaaaagacatcaaaactatactttggtgttcaacaatagtttttagctaaaattctgaccgacttcatttaagggcaccaaaatgactctctaatcaatagtctgactcttctaggtccaagtttctgaaatatgcatacatgaatacagacatacagaagtacaaacgtattgatagattaggcttgctggatgaaattaaatacaaaagcatgggcatgacaataaacaagccttcaacatctgtttaaatggctatataatctgatcatcattcattattgtcatgttatacaacctctgtcaaatacaagcttcttccatccacaaaatctgatcaaggttctctggggtcttttcctatttcctcttgaacatccactaaaaatccaagtcccactagttaacatggtgtcccttgaatatttgctgcaaatccccgtatcatctttaaggctaatacaagctttatcaaatccattttcataacatctatcaaatttatctcaggtcttcctttcttcttctataacccatgtaacaggtctccgagtaattgggacgtcctcaattttgtttgcacctgcaagattttaatcagttcaaagactcgtactctattgatgcatggctgtgtgcaacttatgattttgatgatgcataccactttgaataggtgcttaacaacttttagtagagaaaattaccatatattgagccaacatcactataaattcggctgccatcatctggagttttaagtggcgccgctaaggggacatggatcctttgttctgaagatggaaaatccagggtacaaatatctggcttgctcgaaaatgtgatagttggattcaaggcatggcaatgagatcacattttagttttttgctgaaatttgctgaattttaatcaactaaatctacttaaactagttggctttgttgaatgcctcagggttataaactatccaataatttttggaattttcttgctatccctagagagtatccttggttcccctatttcatggttggactggaattaatagcacagtatcctcattgaactttgtgtggaagttctatgtagattgtggaataagtggatacagttcaaaccatggaagggacacacttattggcatctaggtttcgtcgattcatcccagcatgcttgatttgggcatattgaattgaatcagtgtggaaccgggatggttcgggctgttcaatttggtccagggcaaaattgcgatgaaccgggctgaattgtgatgaaccgccttgtttttgagcaatttcagttagtcatggggatgaactgttttataatttctcttgcaagtatacagcccttcatctcctcatctagttgtgcctgatgctgccccaacctgtgctccatttggtggtattacccctttgattgaccatgctgagctcccatgatgcctccaacattgcctccagcgtcccctcctttgtcgccacaaacgagactgccaaaggtgaggcgatcagcatggaggtaatggcagtgttgatgcctgacctacatggtgctgcatgctgtgtttcagtaaggtatgtaccagtcctgtactgacctggtacttgactagcatgggacatggtaccggttctgcaatcctcagtgcagtaaaagattaagaccacctcttgtgtccttgggaagataataactttggattataaaatctgagactaatatattaccatatttgaccattgggtataaaatcgggtgctctttttgttttgttgggactgagtttggtctacatgagatgatcataaaagtaaaggtttttgcagctgaattattgttttgaatttgttttggtggaaattgatgacctgatttggtagttctgttagtatgttatgagcttatgaactatggaacatggctttgagttctggaaggttggggtgcttagttgcggtatagtaatatttgggagatttatcaaggaatcccattattcatagtcaccaattcagcaagagtttagatgagcaatttagtgatcaatatcatcaccaccaataactgatagcatcattaatttgcaatccatgagtatgcatctgtacattgaatgtcaacaatgaactaaatgtttgcatgattgaatgctttatgtttattttgattgctggagaataatccagagattttttttggccaatgaagaaatcctggataacattgaggctagctgaataatttagagatatgtgctgctgtagcttattcatttttatgcatttttaaatctaagagctaaactggtatttaatcttattatactgcaggctgagaagaatgagcttcgtgatgagaaacagaggctgaaggcagagaaagagaacctggagcagcaaataaagatcctaaatgctcggccaagctttgtagcacaccctcctgtaattccagcggcttttgctccacaaggacaaacagcagcacacaagctgatgatgcctgtcattggctaccctggattccctatgtggcaattcatgccgcctgcggatgttgatacctcacaggatgctgaatcgtgtcctccagttgcttaagaccattgaatgctactttgattaactaatttctctatcgaactgctttggcttgtgtaagaccccattgcttcatttccatttcaggcttagcttagcttgtcagtagtataaccatgaattgaagttgtttggatttcaggtaaattggaaactatctagtggtttaattgtaaattataataataaaaaaaaaatccagcttgaccattagtatcaaagggaaccatggagattctcagacctacagcaagttgtgtgaatattggagaatatggagtggttttgattcagtgtagaaaattttatcctaatttttcatgagtatcgtcaataggatcggcgttcttggtgtatattataaatgaaatgtgcctcgaggaatgattcagcaatattttcgttcaaatcatgcatcaattctctcttggctggcaagcctgaaatcggttctgctcggttcacctgcctgtgcagtagatccgtgatgatcaagggttaaaagagtgctgcaaggtatcaaatactttatgacaaggtagccggtacttcgcaactcaaatgaagagttgtcactcgatgataaaacatcacagcagctccttaactgccactataattaaaataaagataaaagatgattatttgatgttcatggcagctcgtatgggaatgggagagaatatttgaagcaagtctaaagtatgagcagtgtattgctatgctttaatattgaacttctttatatttgacttcttgattgatgccttccctaaagaattcaagctaattcattactcgtctgagatgacaatattaccattgatcaagcaacatgtgttatattgggagtttattagtctcttttttccccaatatttgagacttctgcatcataaatttggttttcttgcatgggttttgttttgcaccatataagagtaccaaggaggtcttcacgagcaggcgtctatatccatcagatttagttatatccatccagttcctccatctagtggttaatttttagtgatatatgtaaggacgtgcatcgcacaggacgtatgtaaaatcaatgcattggcaaatgtttctcaaaaaaaggattggtaagtgatccgaacctatcaaacttgtgaatttcaatcgagaatctgcggagttggtggttctttagataattagaatgtttatgtgttgcttaatcatttttctctcacataacttgtttatgatgtacttgcattagcaattatatatacatggcattgaagaggttctaagaactcatccattcatgacagaatattgaaaataatgtcaaaacatccaagatttaggcactatggtgctgtactattttttgatagatggtgctgtacttcaagatgaagttctttatattatatttttctgcatgagctgccaccatgagaaatttactttatacatgacgcatggtagggatagtgtcaagcttgatcacgcttttagggttttctacgcgctctttgagattttacttcataagagttggctttcttgcattaaattatgtttcaccttatgagtaatataaaagcaagatttccacaaacaggcatttataaccattgggttcagttagattcatccaatccatccttcatagttttatatgcataagtaaatcttcagcgaacagaggctttcagttgttctcgaactggcagtctagtagctcgtcagattggtgcagaactagcttggagagacccaaatgggttagaggcccatgtctgctgggctagacctagctcatacagatctaacctcaaaattctttgaacaccacctgtggtgtaagaaatccgacgggaaatgtatcacttccccacataacaatcatttttcaatacatatttaatatccacagtttcattttttcatttgaaatttgaaaggataaaaatatttttgaaaaaattgtgatatcctgtgttgaaattatgatttctagcacaaaatatcataatctttttacaggatgtcataaagagagaaaaatatttttgtcattgaaaatttataaaatttttatgtgatgaaaatatccctaccaaaattatgacatcctatgaaaaaattatgacatcttgtgcaggaagtcatgatttcaatacagaatgtcataatattcacacaaaatgtcataaatttttcaaaagaaaaaaaaatatttttatcattcaaaattttaaataaaaaaataaaatataaatattaaatatgttattaaatatgtattagaaagtaatgatcatatactctaatatgattggatgatgcatttcataccatttttattgcactgcacgtggtgtacaaagaatctctcaaccaatatgtctatgtggttgggctagatctgctgttttttttttttcttctaaaataaaattataattaaaaaaaaaggtcgaagtatggtccatgtcattgcgggaatagttggcgaacaccaagcaagggtgggcttgatacaagtcgatatcagccatctccatcttcaagaactagcacctgttgccaattaaacaatcaacaacgattgatttaatattcatacagcaacatctttttggaagtctaaacattcacatacacaaatcacgacaacgactacagctaatacacaaatcacgacaacgactacagctaatacggaagcatctttccaacagccacgaccgagcatctttccagcaagccactagagctaacaaacaaaagtcataataacagctgcacctaatataaagcatatttctgccacaagataacacccactacgtgtcatgtaaacaactggcgcaataaaaattgctgcagaaagggaactacgataatcagaacctaccggaaaaaaggaagccacgaagaggaaagaggaaactactacaattagaacttattactgcagagaggaaattaactaggaaatcatgaccaatggtgaattgagagctcaagatgatctccatcattaatctcgtaatctatcattacataaccaattatctgatcctctggaagcggataagtacgtgaagcaccaactgcatgtggaccggctcctctagccggcccatcatttccttcttcacttggcctcatacagggtatggagtgtatcacctgtctcgacgtgatggccagattcatggtcatggatgatgacttcaacagataaagacaccaaggggtccaactaccctagggttgatcgatctcgaccacctcaacttccacctgtggactgattgcatgttctatctcttaatcgatcgttatcctccatccaagtcctcagcctccagaggtgttggcgacggggaggcgggccatagcctcccctctcaaacatcttcttgacatcgtggacggtatgaaggttgcccaaggagcagcagtagataagattgttccatctagaagcgttgtccaaggattcgtaggaacctttctcatgcagtatgatggtcggcaggtcttcaagaccaagccggtgaagagtcttgtgatcatccttcagcaaggtatgcgcatagacaaggatctcatgagtgtcatctggcacctccaattgctgttgaattgcactcttcagctgcccggccgtagagaggtgcccccgtggatgtagggtacgactcgttctcttgtttcactcgaagcacggtgagccacatgtatgtacgaggtttatagagaagtaggagcataatttttgtggatttgaagaggaaataaatatggagaagttgaacaccgatgaccggatcccttgcagtgtgcgatttgcaccatagaatgctatgttgcacttgatggccgccatcagaaaatgaacagttatttgatagctacgaactgtatatggcacataatgctgtttaatttgtttgacaaccattcatcctcagatagcagtcatcgatcatcacacaatattctatggtgcaagccatatgcatcgttgatgattctgctttgaattgacaaaagatttataagtaaagagctttgggaacttttcagaattctgttagtctttaatatggaattcttctccttcatgtgaaagagtattaggtgtcattcatgctattgcatttcaaatttgagacataacgtggccatactatcgagaggtacaatcttcgattatatgaagccaatcaatcataatcaactaaaatctatcacaaataaaatataataaaagattcaatttcatcattcatcaaataaataaatcaagatcggtttagatcatctaaatcccaaatcaaataccaaatttatatcttttaattcataaacaattgactacaaatccataatcatccaataaactaaatctagctataaaattttgaaagtcagacctataaacctagatcatccatcgatcctaactttaatctgctgtaaaagaacaagaaaaataaaaaggtatgagttacaccatcttaataagtaaacctatgctttcttactggatcaagtataaatttttcaatgataatgcattattaagaaaataatagatgatataaaataaaatattttataagatatataataaaataaatcatacaatcagtcatgcatacataaatcataaatattttataaatatgatgattcataagtcattttgatcatatgttcatatcatatttcaaaatcttactcacagatatttatgctgtagtcactttgatcatattttttaatcgacaaatttcttgtttcatatgtcaactttgtctccattgacgaggtcatatttcttatggatgttaatttcggatattgacctttctaattttagagatttgtttatagctgtttgagagcttttgaaatctttacatctttttcttaatatatatagtagataaaaaataataaaatttatgcttcataaatatgctactttcatatattcatgagatcatttatcataataaaatatattttttcatatctcatgtactgatccttattttataaaaaatatgatttattagtaatagatcatatgtatagaaaatatgataattttaaaatgaataaaaagcataagatctacttacctcattcatcctaaatctttcgacttcattagaagaatcagctaattctatttaaaatattaaattataatcaattttttaattaatttaattaaatgatcataaaaggagattattgattggatgatcagtccaatagaccacttggttaccaaagcagttcaggatcttcttattgggatcaacacgggtcattaaaataggaaggcatgactgaatatggggtccataagtattttagagagaaaaaataagtgaagagagagagaataggaaagagagaaagaaagagtcttcatctcttctagaagaggaatctaagatcaggatcattaagggtcatgttaggatgcatgcactatcggcagctggccgtggctggacataaagagaagaaaaaactccaaaataagagattcataggttatcttagagaaagaaagtagagagagatacaaaagagagaaagagagctggtctctcccttttctttttttttccttctcttttcttcttcttcttctattcttttcttcttcttttctttggccgaataggaaaagaagggttggttggtccatggtgatgaccaaaggtccaaaggtggtgagcgtgaaggttgggtcggtagcaggtggtggtggacaactaacggaccaacggtgatgcccaattgatggggaaaacataggaagggctcgaaaaatagaaatttgcctccttttcttggtcttttcaatcgttggccagaaaagaggggaaaaaaaaaccaaaaaatagaagaaagcattcatgatggaaatctggtgcgatttcgatgagtccagtggcttgtgggagtgcctgaggccatagaaagaagtgaaagtgaaaaggaaggaaggtcagggatttatctcgatttttagtgaactcttcagcttcaaattccaactgatacaaaaactacgtgctaagagagaggggggggggggggtcccatgttcatcaatcaaggaccatggaggggaggggaaatcttttataggttttggtagcccttggagtcttcttcaaacccttttttttttttcggatgggagttgtcggctaacattgtgacgggctggtttaataaaccaggctatcacacatgcaatttctccgctctttggcgtgcaaaaggatgcgaggtgtttgtttttgctcagaaaagaaaagaatgttaggtgttcgttgaaaattcaactcacatgacctgaaaatattcctttcgaactcctgaagccttgcttgatgtgtaatattgttgtttaaatacttcataatctggccacagccagcaattagtgttgctgaggacatggcgaatatttgttggttgggaattgtgggccctcatttttttttttgggatctaaggctctcatccaacgtaacgagctccgaactgtggttaacaatttcaccaagcattaatcgggttaaacatttttttggagtcacgagcctgaccgtgaggtttcacctaagatgatccaggataggaggataagatcatgcttaacttgctgccaacccgtcattagaggtccttaccgtttattgcaactgccaaaccttcattcattggcacatgtagtgcgagccatatatcaccgttaatgcatatataccaacatgacgccttgtaccgcattgatgcaaatacaatgcacgcatgacaaataaatctaatagccgaataccaataaagagaatatgcacccatgtctaactatttggttgttacaaaggaggcatgtgcctgacataaaaacataaatagaaacaagaaacagacaaaactcgcttataaccggttgtaacgggacccgtagctaactaatcagccatctgattcccttcacgataaatttgagtagcctaaagacttgtaacacaattttcattcgcaatatgtctacttatcaagtatggaccacactataggtaaatttgaaaaaatctttgatttggacaactagacacgagcatttttgggaaagaacgggacaataaaatcatggtggaaaaaaaaatcctcgaatctattttacagtgtaggtgggcaatggagtaagactgaatagatctaatcccagatggattaagtgctatttttcgaattatagaagacttagtgaagttagaactaattttagatgaataaactataattgatccaatttaataaaatgtaactaaattgatcaataagtagagtatgagatctatgttaaatggaatctttctagatgtactcaaaaaataataataataaccaaaaactgtggaatttttttttttaatggtagtggaggctgaaaccagccaccacataattgttaatgatcagaaaggttacaggacataaaagttgttacataattctggcaggcctccaaaagacagagccctgcattgcaaaaaaaaaacatagctctgctttaccaaacagagcctcctgagtatgaaataagctgaaggaagtagaaacagcttacatcaaaagtctctggagtgtggagaggtgggaaatgaagttcgaaaattagttacttcaggtctctgtgtattcctcttactactatccaaattttttcaaactctaggattgctgtttgcttacaaagcatagactctggaattggaaggagaatgggtgactcccattccaatcatttggttcggaggagtaccatttcaattctgattctgggatggaatgaaaatagcccaatctatatagaactcaattgctactctcctttatagatttaaatttttattccaatttcgatcatgaatcaagcactttgtgggatttggccattccgattccgattctgattccaagtcatttcgattctcatttcaatgttgattccgattccgatcgtgaaccaagcatcttcttaaagcatttgaggcaataaatgagcattgcactctttccagcaagaccacacaaatgcagtcatgagcattcagacaataggctgagatttttttcggatattcttaagaatccaatcgtaacataggaacttgaaagatgattgaggatgaagaacctgaagggcagagcagattgctttccaaatgtttggaaaaaggttgcagatagagaagtggcgatccatggatttatgatgcattattgcagatcacacagccatctaagttctatcttagctttttgccaagaacttctccagtattcagtttatttttccaacaaaaccgcatgaagcattaactccaaaagtgtggaattggggagaaaaacgagcgcgttggttggcggcctcaactccaaaagctggcggaaaaaaaaaggaaatgtgtgcaaatgtggtctccctcaaaatcatggtttttctatatgcgtttcttcctcacatgcagagcacttcaggattctagttaacaggaaaaagtgtagaatcgaattcttgttgggcctgtaaaaatcttgttaacagtgttacagtgagacatataaaatactaaaaaatgaaaagaaaaagggtgggaggtaggatcagccgatggtagaagaaagcacgtgacaagccactaatagggagagggaagctggacagaaatatcatatgaaaggtattagttaatgaaaattaaattgtagaatggaaagatatagttgttttctcacttatatcctcagcattttcttttaaactttacaattatagatcgaagttatgtcattagtggcttgtttagtgacacttcctaggaccaaaatcaggcctaactactagttgacctgacacagtgtgggtcgggtgaaacaatagggccactagacctgattgaccttatgaattctctcttatttagacttgaacctgaaccaattattaataagtaaagtctaggtcaaaatttatacccaaacccctcataaagtcagagcctgcgttaggccaccccgagggtttgtcaagattaactttgatggtagtgttagagatgggaggggtagtgcgggctttatcatccgcggccctgacggaaggcttttggtggctggtggatctcatctttttgagctttcaattccaatgacagagcttcatacaatttggacggacgtcacttttgccagacaacagcttcatatggagaggatcttcctggaggatgcctctgctactgttatttcttagatttaggggggcaccatgctgctcgaggttcatccgcttatccgggatgtctggttctcccttcgttaagctgttgcagtgcgagtccgacatgtctatcggaaagcaaacactgcagcagattgggtagcggcttttgttgctgagcactcaggcgattgactgtgaaggtcaggtgatgattgtcctcagatcttgtagaattttgtgtattttgattttttaagctgctctcgcattagattgatgtgatcatctatttatgtatattaaaaaaaaaatgcagcctgcgttgggaggtagcggatccaactcaacgtgattgcacctcaggacttcataacgttgagttggacctctggacttcataacctctttatattatggcattaatatataataatagctaacaattgaaatagtcattagttttcggagaaatttattttatggggaatcctaatccgctgaaaagtcgttctcttttatctgggtcgagcaatttacatccaagaatttataatggaccctttttcgagagagaagttcgagagattgattttggggacgagaaagttattctgccaagggctgtttcaaaggaccagaccctctatttattttctcagttaacaattaataaaattttgagatttcttattgaagagcagagatccacatataatccccaggagaaacagctcaaaaaactatcgacatcagaaaaaataaatggtaaaatagaaagcaagtggctcaacaaaatgatactcagttcaaatacaaatcctctctagcttgtgctcatagagacaaaaccaagagcatccccaccccgaaccccattgcgacctttatatcctgaccaagtccattagccgctgaccggggtggtggtgccggtgaagtggtggtcgcaggcaaatctgaagctgatggctcgggggacggagaaatggtcgccggcgagctcgaaggagcttttgatggtgcagccttggaaggcttagaagattttggggcttcagttggtggggaagacatggggaggggtggagaagcaggggcagccgttggtggagttgcggtggcggcagaaaccacgtcgatttcgaccttcatcccttggctgcagtgccctggtgtcccgcagatgaagtatctcttccccggcgatgaaagcttgacgacggtgcttccacctgtgtaagtgttcgttggtttgcttgtcgcgcatgcatcgtactccgccttcgacacctcgagcacgtcatgaaatgatgcgtatttgaaagctgcatgccccaaagagcaacaggaaattgacgacggctgatgtgagcaagaggcatgaagttgtagttattcactaagtagcacttctcttataatttctacgcgccagttgagtgaacaggagttaggactttggttttggacccagaaaactgtatacaatccagagattttaccacccagatggtgttagatcttgagtgggtacgaatcttggggatgtaattttgttcagtaattgacccaagtgattgtatttgtccatctttatgctggaaatcatctgttgtatgcatcaaattttgatttttttttttttgtttcacaagggagaaataggctattaatgcctaaaggattttattgattaggaaagaaagcatgcaagaaagaaagaaagaaagtagaaacagagcaactccaagagacttttgaaacaaagaatgtatgtatagaaccactgctaccaaaagagacctgctttgtgccctaaaacactagtggatacgagataatctcagggcaactaggagcaatcttaaaatcgcaactgaatttgaaaaaagagtgtacgaatgcagtcttaaatgcaaagacttgtgtttatttctgacatgaaaatgacaagccaacgagccaatttgaatgattacattttgtttctctcaaaaagaaaaaaaaaagggagaaaaagaatgatggcaatccattgcaaaaactacggattatgcaatgaaaaatttggatgtaggtgtaacttactcaggctgtccccagcgatgaacttctgggttgcagcccatgatgccaggttggtgctcagatcccatccaccattttggcctccgacggggaaacttgcgccgattgccacctgaacaagagctgctatcgtcgcaacacctataaaagctctcaatgccaacatctttgcctaagaggatacagaactaggcgaatgaaaggaaagtatgatttggagttctctcgcagccggttgagaacatatatagagtctgctagtagagaccttgcgcaagggcaagccataaattataagggaaaatgcgttgtgacaggtggacttcaccaagagttgttgggttgagtttgcgtagaagttggtagacctctaaatccaatttgcaccaggctgcgtcgttggtaaaagttgaaagctgcgaagccatgtgtttggtgtgaacttttgggtggtggagtactcctttatgatttaaagttgtggggtctttgcacagctggtaacttggcccatgttttcatggaacgatcgtgtggatgtgccccatccaaataatttataagcgtttggtgaacagcattgattgaagacaaaatttctaatcatgcatccaatgtgaagtagagatcagttaatgtggccaactacaaagaaaactttattgtggagtgctgcactagatattctttctgattttttacatattttatttcctgactcccgaagatgtatatattttacttggttggtatgataaattcatcttaaccaaaaaaatagagattggttagttttaatcaataatgtttcccaagattcatgctgtcctaaattatatttcataacctgttctagaatcatgcgatgactgttctacttctaatattgggattccataagtagggttaatattcatatagtatatggttgtacttaaactaattgttgctattcgattcagtcgaagttggagagaagacggctgagtcttgcacagagatactggtactagagtgatctgtaaaacacgagactcaagtcagatttagagaacaataggagtagcaatgagttctctgaaaggaattgattggcttatcttgatcttggagactttggttgtttatatagaagattgtcgaatagctggtcatatagctgtatgaaaattatgagatttcgagattgcagagctgttcaacatgttataatggatgaaatatttcattcttcaatcgttcctgtgagattagaaaaattggttatgtctgagtttatccactcgaggtggacagctgtagtacacatctgaagtgagtcgactgtgataacagagacaactcatacgctaagacatcggcctatcgatgcaatggagatcgttggacagactatatgatagatcagacgcaagctgtttggcactgtatatggttctgctcttaagtcagtggttttggtgataatttgaagatctgagatgtgccatggttggcacactgatccgaggtactcacagtaaccaccgtaatactaataaagtttgaatttcatgaagagcatcacttcttatataactatatttaacatgggaaataagctgatgttattattgtatacctcaatcggaatacgaaatttccatgaaacttcggagctggaaatgtgaagaccgcggaccctgggcttcaaatggcttgcaatccattttatatggagaggttttgggtggtagttctccgctgcttcctttttaatcaaaaaatatggagaggttttggtgaaacccatatcaatgaataaggacacgagatagaggcagagagcatagacgaataaggaccattctcacccatattaattgccttgagaaaaagattccattcagaagtctccaataggatgattttcatttttttgtagcctcgggtttatatgctaccaccagggaacaaacgctagcatgtaccaggcttatcagctcctctgaaggtcagaaacctatctgaacatggacccaatagttctaccatagacaaaaaaattgattaggtgatatccagttctggtgtctaccaaactaaaaaaacaagtgggtgcagttcacatgcaacgctttcacatgggtcattcctaaccattaagacctcagaaagcgtggtccctcccaacaaatccacaatgtccgcctagtggaacacaactacatctccaatatcaatgttcccttatattaattggagaaccatccccttttttttacttgcaattctattggggttgatgcagtcttgcaatttttatagctctctaggccttctgcatgaatcagtgctcgaacccaaaatttgatccatttgtctgcacaccagatttggtgttccattcatatgtagtagtttttgtaaactatttagacccctagacgggagaaccttattattataagtcctcccatcttctgtgtaccaaatttgatttgatgacacgaggaaagaagcattcgcttgttaggaacttacattggagatgtcatttatcaggctttaccacatataactatcatcaatattctggtcatacaagaatagtgttaggtggatgtctggctaggataccaccttctaaaattttttcgatactgcgcgatgcagtagaaagaaagaaaaaataaaacagtaacaattaaaataagtggatcagccacaaaagggctcgtcttcatggggcatgcaaacttcactatgaaaaaaaaattttacaagtggagatctcaccctcaaccttcgtatacccaatttctctctcacagaaagtttttcctcacaaaagctctctctcttagaagacccccctgaactcctgaagcgaccgctgtctgctatccagaagcctccctgaagctccttcttttctcgatcacaaggctctctctctcttcatagggtccgtggtctttgcactgcataggaaaacacgccacaggttctgttcccgtgagaaaaaccaagcccccctccctgataccaatgttcccagccttttaaaagcctaaataggtgttagaaagggactagaactcttaatcaacctcaaatcaagtttcaaaccattggatcaagactagaatcaatctacgtcgttggattgcactccgatccacagaatagtatcgtggactgcaagaaacgattggaaaatgccaacgcagtccacgcgttggatcgtggaccattcggtccatggtggaccagggtacaggccctaggtgcggcgtctggacttgggttggctcgcgcatgcgggcctggaccgcacctgtgccgggcgcctgggcccgggccacgccccgcgtgcgcgcttgggttgggctgcacgcccacgcctgggccgcgcactcggcgccaggccgcaccctgccgcacctggccccgcactgtcgtgctctgggcggcatcccgctgccgctccaccggcccatcgcctgccaccggcggcctccactgtctcgagttgcgtgccgacttcaaaagtacatatcttctctgtccgagctccgtttgggatgatcttggtctcgttggactccatttttcatcgcaaaccttactgtgggctcaatgtagaccgaatcttgaagcatcaaatcttaacaatcttcatctcgactcgatattcgacctcctcctaactccgagagcttctggatctcttcacccccataccttgggataattgtctgttgatcatgaatggacaaacatgaaagtcgagccaggccgctcgatctcatctctgtcgtatgctatgctcttcctgacctgagacctatttgggacatcgtcctgtggtaataggaatttcaccttgcaacgtcgcctctcgtccttttgagtctcctatttcatgtccgatccacctccagctggagctccaccttgctctggactccacctagccctcgaagctccacctcgcactgggctccttgccagatagtaatatcctctgctctccttctttccctctagcacaatcctatcaccgtgaagcaccttcaggattcctccactgactaccgtcctgtaacctctcgaattcgttctgctaagtgagataagactccacctgaaatcggatatatatcggacctcccccaatcttctcactgcaccatcatgtatcctccaactaaccattccgatgcctctgatcgcacagctcgatccatccgatagatatacagtgccctcactgttctctagggagtcaaattgctcatctctgcaacatacatgatgggtgcatgcagaatctaatattcactgctgggaagaagtagatacctcatcagatatctctaaaatatctctatctgaatcgctgtcggtcgttgctacagcagccaccatctaatttttgagttgaagataatttctgactagatgccctaactcctcacactggtaatacctgattttactcaaatccctccaagacttggaccgctctcgtcgcgatctcctgtcgctccgtctaccgcctcctgctcctccaaaagtcatcaagactgagctaccgccacctgagctcgaagccgggttctccctcctgagaacctcattctggagtatcaccgcggtgacctcatccatcttgatggtatttttctccactagaagggcagtcaccaaagactcgtatgaaggtggaagcaacactagcaaaatcagcgctctgatcttctcctcaacattctcaccaatactgaggaggtcggtgaggatcttctggaagtaacttagatgctcttgcacgctctgtccctctgccatccgtagttggtaaaactgcctccagaagaaaagagtattggtgagagacttcgccatgtacaactcctcgagcttcgaccacagcaccgttgaaaaagtctcgctcagcacatggtcaccacctcatccgtcagatacatgcggatggtactcaccgtctgcatctgtagccattttcaatcctgcacctttatggttgtcggcttctcatcgcacaagagagtatcgatcaatccttgttggatgagcacgtccttcacctttgcctgtcataaggagaaattgctcttaccatcaaatttattgatctccatcttgattgttcctgtcttttccattttcagtcttgctcaccaccgctgcaatctgcgtcctggtacctccttgctttaatactacttgttgggtggatgtctggtcaggacaccatctcccaagatcttttcggtactgtgcgatgcagcaggaagaaagaagaaataaaatagtaacaatcaaaatacgtggatcagccacaaaagggctcgcctctacggggcatgcaaacttcactatgaaaaaatttttttataagaagagatctcaccctcaaccctcgtatatccaatttttttctcacagaaagtttttctttataaaagctctctctcttggaagacccccttgaacccctgaagcgatcattgtctgctgtccagaaacctctctgaagctccttcttttctcgatcacacggttctctctcttcacagggttcgtggtctttgcactgcacgggaaaatatgccacaggttctgttcccgtgagaaaaaccaagcctccctctctaataccagggttcccaaccttttaaaggcttaaacaggtgttagaaaaagataagaactcctaatcaacctcaaatcaaatcccaaaccattggatcaagatcgaaattaacccacgccattggatcgcacttcgatccaaagaatagtaccatggactacgagaaatagctgaaaaatgcccacacgatccacgtgctgggccttggaccacccggtccacgatggaccggggtataggccccatgcgcgatgcctgggctgcgctcgtgccgggcgcctgggcccgggccgcgccccgtgtgtgcccctgggttgggccacgcacccgtgcctgggccgcgcctggcccatgcactgccgcacgctgggcagcgcaccgccgccgctccaccggctgccagtggtcctccgctacctcgagttgcgtgtcgacttaaaaagcacgtgtcttctccattcaagctccgtttggggtgattttgatctcgttggactccatttttcatcacgaacctcattgtaagctcaatgtagaccgaatcttgagacgtcaaatcttaacaaatagtgcatgatagtcttcttgaaccagctcctgtaagtcagtagaaggtacccttctcttttcctgcttgaatacaaattttctgttctttggtaagagatgaaaaggtttatataaacttagatgtatatatctaatcttttgcacagctgcttgatgggcatgaaggttagatatcaacaactatactcacatgcttagcttaagttctaatatttcctgtttcaactgcaacactttttggttacagtttctactgcaacattaagttggttttgctgaaatacctcaaggcaaggtcttggtaattgcatttttagaaactgcccttccatcccggaagtgaggcacggtcaatgaattattcaataccaaactaagaaatggtgtgcatgactggtaaagttaattcgctccaggtaaccttagatgtactttgcagggctactataacgtgatctcactacttggattggaaaggacaacgtggcttcaattttgcacgtatatgagcaggatttgagttaaacttttgtctccatatatagcatatatatatatatatatatatatatatatatatatatatatatatatatannnnnnnnnnnnnnnnnnnntatatatatatatatatatatatatatatatatatatatatatatatacacacatacatacatacataactattatggaatatattcgctgtggatggcgactattagacaccttttatatagaatatccagatcagctctagttggtttggagctatatcaaacatagataaaatggggacaatgtcaaaccaggtgatggttccccttgatgcttggtctaaataacaagtcacttcaacattaggaccatcgatgttttttgctcgttctagaaataagaggtcgattggtccatcattccgcatcacaattttaaaacagaaccaaaaaaaggtaagatcgtttcagaatcagaacctaaccaagaatccaacttatatacctgtgcctctcaagaagaagaaaaaaaaaagatgacaaagtcctccaatattaatgcacgagccatcaggtggtccttggcatgttatcatgcgaaaattctgagccatgaaaacttagtaggtctgtcagttgaacaagaccatctgtgcaaaagaggaggtgatgaccatgcactcgaagaagcttgtgagacataatggattggccatcaaggcaaatgaagcaacaacaatttaatcaggatgcagtatttttttttccccaatccattaaggtagaaggtgaactaaaattcgacaaacctccatttccactagattgacctttaagctaaccggctcaaattcttctcatgagtattttatttttcaaaaagtaaaaggtggttcttgcaaaatacaagacaagagaaaaggaaccatgtaatttggatgaacatcatgaatattaaaaccatcgattttttctgcttgttcaatgaataagagtttggtcttttgttctatatcataattataaaacagaattattgtgatataaaaagaaggacatcattagtcattggttgtgagttgaaaagaactcgagcttatataagaagggatcatccatttcatgtgagatgctttttaaagagcaaaaccataagacctatagatcagaacagacaacacctcacataccgagctataagtctttggccatatagaaaagggaccatcactttgtttttaaaacaagatggctgttgcattcaagatgactcaaatgatggaaataaaagtgctctctatattctttctgagcataatggatgcgagcacttgtgtcacctttcagtttgtcgccatccccactacaacatcatatgtaacagcataagttcaggagtccgtaacttgtatttggtctttgagaaaaatatcatatagcataatcatgagatcttagaattttcagaaccgtcattgaaagtgaacaacatttgttgctgaacctgagaagagaaggcataattgagataaataaggttttagcttgtcatatcgacctgtgcctgggcaaccaaaaaataaacatttaaaaatatttcatttctatatactcttttatattcaattttattctttattataaaaataaatccgtaattctttttggttagaaattctgaataggataaatgaaatgcatgaattcagctggtcatcacactttattggtagatttggcttgagaggaactcccaaagttttctcaagaagaaatcgtcgggcaacccagttcttcacaaaatactcatacatttcagcttaggaggaatctatgctccaataaaacactgctagccatcgcttacttttgagttttccatccccagcgatgcattttagctccatttgaggattattatgctctaatccctaaatcgatcttctcctttgtgcacttttgtacctgtgcttctttttttttttttgattcttcaatatagctggggggaactgacttagttcttccatcactattcaagaaaaaagataggataaatgaataaatgaaaaaatatatttcttttggtaatttcagatgaataaaaactctctcaatagttgaataaagttatcctaacccttctttctgactagatttatgcgattaaggtggttatgtatctatgaccaaaatgaaatcatgttggttaaagatgaatataattttggtatttggccgcataaatcccgtattatgcacttaattatttttttttttgcaaatcaaacacagaggattgcagttccaacagaagtaggcatgctcaggcagccattcagatgaagcagctactattatgacttatttgtgcatgagagttttcatgtaagtgctgcgtgttccaaccaagagaactctagtccatgaaactattaatcacctgggtccaagataagattttagcaacatcaaatagatgttttcctgagcctggccttctgatagtataaatcagagttcaaagccaaattccgtgagaaaggcgcacactcacagagagagaaagagagagagagaggcggtgggggggtggggcaggtcagtatcttctttctttctttccgtcatattttcctctttttccagagaaagttgatggaacgtccacattgctttgtttcaaagagattaaaattatttacccccccccaaaaagaagagattaaaattaagcaaacagctctctacagatatggcatacattaggcagcagggcccaaattccgaggactaatatcagattacaaattcaccttctctcttcctaagaagccgaataccatttatttatgatctgcagaggcttatagaaagcttaacaaggtggtttgaagcccatgtagctcccagtggtgtattgtctccaaacatcaattgctccaaagcaagtaattgaaaccgtgctgagaaccatcaccatgctaaccataaacacaatgatagacaccctacctgacttttgtatggctttctctatgatagccagcccaagagctgaagccacaaaagaaactgcagcataaattgaagctcgaccgatccccttcatgcccaggatgacatactgaaccatggacatcgaagccgagaacagaacaatgaaagtggttgttgctgccgtaatctgaaaatcaaaagttaaagcatatgaactgataacacaagatatactatagacggaagtcaaatgcaacaagatttttgctataatgggatcaaatttaattgctcaggaagttgaaaatgttataaatatgtgtaaaagcttgataagttgattctgaaagtttaaaagtagcctaatattataaattcatagcaactctggcctgctgttgaggctaaatgttttattttttaaacataatttatgctaaagctccatggtatttggccgaaagatgaagaagacgatggacaaacctgatcatgaatcaagtaataaatgaagagaaatatcgtttgagttgcagccgaccgttttcgcttgtaaacaccaaaaaaggattatgggacttgaaatatctccgatacaagattctatgggagagactatcctcaatagcggctgggaatctaagaatgacagacacggttgagtctattttggaggtctttttccggtgattggtctcagaagtcaattggtttcagatatgtggtccgattggacactttctgggtgatgacgtaaggcaccgtaggagaggctgggttgatgtcgttgggatcttcttttcattgtcgttttgttttggtttcctttggtttgtccttcctgtatattctcttccctgtagcctttctctccgttccttgcttccccctgaatatattctccattaataaaacagggtgggaaactttgcttcccttcacttcacttcaaaagagagagagagcaagccaagcttgagattggataaccatattttctcgggccaattactaggttaaatcatgactaggagaagaatagatttacaagttcttattttgttttccaaaaatatatgaaaaggctttttctgaaaaatatcagtttccgagtagcatgagggaaagtagaattacctgtggaggtatccctatctgaagaagcacagggtttatgagcaatcccccaccaatgccaaaaaggccacctaaaacccctgtgaagagggcagctgatggaaaaacaaacatgggcaaggcttccatcctggtttccgctgcaatgtcctatatgataaagtggttgattcatgccacatcaaatgtgacagacagagacgcactacagcaaaaattaatctattaaccaaccttgccatctatatcttgttgactttgaggttgtaatcttttcttcttcttgtcatacagaatatatgctgtaaaaacaatggcaaaaggaacttgggataatgtgatgagccaatatgcaactccacatggttttatgtttacaacaccctgaacagagaatatgatcaaacgaagttagtgtggttactcattacaaagacataaatgactcaaagcggaattgaagaatgaaacgactcaatggcagccccttcgagctttcaaatccatttacatggggaagtttgagaatccagtatgatgtggcttttggcaacctataatgcaacatctgagagcatggaacacacacaagcacttggtagttccttcagatggtcgtacatgcataaataaaccttataattttgcatacttatggtcattttgaagtgtgtttttcttcaaatgtttctagcgtaaatgatgttcggatcacaaagataggattggtgttatataccccgtggttcaatatttgagaaggttattcacgggacactggaagcacatcatcaggtgcacgatgaaggcagatggtttggttgttgtactacatttctgcatatgttaatatgcagagcgagccttcaaattactaattcacctggatgtcagcacagcatgtgaatggttaggaggtaaacaggagtattgagttgtggatttggaaatgaagctctaatcaaagatcaagataactggaaaagatgttgcaaaagatctggtccttgtgacagaaaagtagtggttgctgtggaaaggagaaatgagaataaccagaattggtttggaggagaagcaatctacagccttaccttcagttacagaaaccatcatacgataagtacataatccttacaataacaacaacaacaatgaagtggaaagcaaggcatagacatatttgcttgaacaacattaaacaataataagatttgtccctaagaagatacaaattttaatagatttttaatggggatatggtgatttctgttcattgataaggtagctgaaatatcaatgatgagtattagtaccgcaattagttcgatcatggagaaggaataattctcccaacttgctccactcaaatctcttgaaagaaatttagaaaaatatattatgaagattgagtttacatcccatttttttcattgatgatgataaaggtaaggtacatagtttctatttataatgatgatatctgtccttatgcaatttcgattggatttctctcttagttctaataggacttttttttttctaaacagacaagactaatagagataaatatgagaacattaaaattctacaaaagatagatcttgacttttatattaacttagccttctatcacttcatatgattcttctcggattgggataatgcttagttaaaatctttcctaaaaagaacattttctttttatccagctcatttcagggcctaaatgatggaatttatacttggccactaatttcaccctttgaggagggtgtcacattgtaaatcttaaaaaattatccaaaaattgttttaatcaggcatcatatgaccaaattatgcctttcgaaaattagactcgtgacacagcttcctcatgtggcagattttgttcttggatcctaaccctctttataatcaccaaaatggtccacatcgtgtctgactatttttctgaattaataatgtttctgtaataactcaacaacccttccattttcttgtcttgatatttgagtacacttttcaaaaactttgaggatatgtacagacaaatatgtagtcttatattgattatttactaggaagatcttgagtacttatacaaagcaaatgaacccaaataatatcttccggctagccattttgagtaaggtcatgggttgtgacaaatagtataagagccgatttaacctataatttatgtggactaggagatactatagcataggtttattggggttgactaagagccaatcatgatgtttcatgaatggatgcatggatttggacatttagcctggcaaagaagccaaaacttaaatggagagaatatgtgaaaatgcgtgcaggcgtgtatatagtcctacatcgattatttattgtgaaaatcttgattatttatataggatcaagaaatctaaataatatcttacagctagtcttttagatgaggtcttagattgtgtcaaaaatagttcaagcgaaaaaaaaaaaaagagatgtgtaattgtttgcagcatatgatagtaccttttaatgtttaaagtcaatggacttcaatatctacccagccactaacaaagtgaacagaatccaagctgacagaaagttactgcatgcgagccaccacccaatccaacccaaccctgtcacggccttggtggaccagctctttttcaggatcagcttgattgggccggtgtccatgccctatgaggtcatggcggctatattattagacccacttgacccgatctgatgtaaaaacagaaaaccacatcaactccatctttacccacattccctaccggactaaaacatacaaagtagatttgtccagaaatcccctggtagacattcgaaggcattatattcaacataatattttctattttgtaagaacgagcaaaagcaagcacgagccaacagagctagatttacctcattatcatgacaagctgaaccaaagaactggagcaccaaaactagaaagaaagaacacagttgcaacaaattagaacttgaccatgtaaggctgtaatcctcctttagttcagcaagaacaaggcttatgctttaatctgccgtgctgatgccactagcctcaaatgccaaatgcactagaaggatcactgttatagttagctcatagtcggctacttaagctaaataatggagggggaaacaatcaagtctctggaagttccatatggattcaggtagaaagtcatttggcctaaagaatacactgttccatgtggtggatttaaagcttagtgataagatatttctagcagaaccacctaggtagtttgtccttcacatggaaacatatggagtgcaagcaagcagacaaacaaagaggtgaataaaggaatcttaccttcccggctttgtctcctaggaggacatgtagcacaaagaaacagagccagatcatcagcaagaccaccagatccttccaaggaaccctcagcccacccccttctcctccacccaagaaaggctcttccatccccttctcatccacttcattcccacccctctcaagcctaaaagcctcacctctcctcacctcctctgtctctaatctccagaacttgaacccagcactgcaggtcttataggtggagcttgcaaggaaggcggcaaaaagggcagtgattagccactctgggaacataatgttgcaaaccactccgatactcactcctaagagcatgcatggctccgagagcagacaaatctcatagttgatcaaggtcttgcctccaggacctgggcttgcgaagaagatgttatataacacattggatagtgaacctgccgtgaccatgaaggctgagtgactggtggatgacttgaggtctaggccagccacaaggttcaggatggggaggtagagggagccaccaccaacccctcctgcactagaaacagaggcagctatgaaacagaggatccatgcaataattatacggtactctgcccttgactcttccttttggagctccaattgatggttcccccggtgagataattgggggaggaggtgctctaggccatggggctgtgacttgtgttgggtctcttggctagcggcgaggtgagctacggagaggatgatgagtgggaggagaatccgtttaagaaaatttagggaattccccattgaccccgggagttttggtgctgaagtggcggacatttctgggggttgcggcctttatatacacatttttctggcggaggatttcgataattgttttgagttccaaagtacatgtatgtgggaaagttgatatttataatgtgaaaaaaacgcatatccttatcagagtttaagaagttagatctgtaaccttttttgtatttcctcttagtaatccaaagaatgtattttaatatttttataataaccatagcctgagaggccgcgtcagtatatgaatctaacctagtaatacaagtggtaattatgaatgcaatagcaaatcgtcattgttgctgtgacgggaaagaatgttctgtcttcgtgggcacgcgctagaaatggcaatgccaagccgcccggctaatggtacaaaaataaaataaataaataaccaacatgctgttggcgtacgacatgatggggattgatgcgagtcgggggaaaaaaaaaaggattgattcacgctatttttcaatacaagaaaggagataagcctgtaaataaaagaaacctaggatcttaaaaagctatatcagagctaggaatccgggcaagagaaagatctcctctttggaagagaaaatggctatgccgtgctttaccatcaattgcccattatcatttctaatgataaaactggtagcagaattagttcctcttacggctccatcaaaattaatctttaatactccgagaagaggagcaacaaatagactatgatggtatgattcagctaatgctaacatatatgataactgttgggatatatcgattgatccctgtacgtcgacttatcttcggaccgatccgaccgacgtctgactctatccaccggaccgatggatgactccaacaacgactccgacaataactactgacaatggctgccgacaatattcgaccgaaagtatgccgatcaaatagaccaatactgtttccaaccgaccgaacggctgaactcatatcaccgactcactgtagggggtggcagccgacgtccgacttccacaaggcactagatcagctgacggtgtctcagagtcaccatccgaccatccgacagtcgaataccgacatatagtcggccaacccgtccaaacgctgtacaatcgctatggactgttgccccgtcagggacatgtggtacggccgtcctggggcattgtcctgctaaggacatggattaattccaatgacttgacaacccacggtgatttgacagtcctcgacgatttgacaactctccagctgtctgtaccattaatggcaggaccatactgcattctactataaaacggggtaagacaacagttttggtaagcgcttttaagctcttgagctctctagctctctctctctctccctcgctgagcccctaatttttcactgttgcctggtctcctctctgacttgaccatcggagggtctccatcggaggcatctccagtcagtgaggacttttcttgcaggtgcgcgaccccagcgatcgggcgacggggggattggccacaacagatttggcacgctaggtaggagcattcgacggaggtaagacagcgagctccatagagcttgaaaaatcgttcgagatgacaaaaatcagggctcagcgatcgagagctatcggatcggtgaggcactctttccgtcgggaagaggccccttctttattctccatggcggaacccagctctccgcatctggtggtgaccacagacgcataaattgcgacgatcgtgcggcaaatgactgttttgacggatgcagtcaaaaacctccagcaacaaccgacttagttgccgcaaccaccggcagaacaaccgccggtggaataactgacggtgcaccctatgccatccagaagcagccaccgacgtccacgtcaactttcgtctcctcaagagcagccgtctcaacactcccatcgagaaggagtgaggcggccacagcgtgacacccgtcagtcttgacatccctctcctttccaactggagcgagcgaggaaagagaagcggctgcgaacatcgtctgcctcactctcaaattcgtcgggaggttcaacccctgggatttctcaacaccgacggttagacgactacgaatgtaagttcgaagaaatcgaccgttggcttgtccatctccaggcagatggtcagaagtcttcgaacgacgtcgacttccggaccacccaacctttcttccgatttatcctcgatgaaccaatccctagtnnnnnnnnnnnnnnnnnnnnctggagagctacaagactctcatgataattcaaggggcaaccgatgccctcctctgcatcggcttctccaccatgcttcgtaaagctgtcagggcctggtactctggtctctgctcaggatgtacccactccttcaggcagctcgagcattctttcgtggtctatttcagcaccagtcggaaaccaccacgaacctcggacagtcttttctccctcaagcagggagaaaatgagacgttctgacactttgtggctcgattcaatgcagccacacttgaggtccgggacctcaatgaagacatggctatctcggccatgaagagggggctaagggggtcccgattcacatattccttggacgagaccctcccccagacgtatgctgaattgctggagcgcgcgtacaaatacatgcacgcggatgaaggagtttccgactagtgcctgactgagggcacgggccagaaggagaagcagaagaaaagtcgggctcctgctgaacccagcaggcccccgatcgatagatgagtctcgccccgacgacggagtttgagactaacgcatcgcaggtatgactcctacacccctctctctgctcctcgtgcgcagatcctgatggagatcgaaggagcggaatacctgcgatggcctccacctctaaagacaaagggcctcgatcggagaaaatactgtcgattccatcgggaccacggtcacaacatcgaacaatgcatccaactcaaggatgaatagaggccctcatacgacgagggtatctcgaaaagtatcgaagggacccaccggctcgaccccttcccgacagactaccccaaccgactgaagaggtagcgaataatcagcctactgttggagtcatcaatatgatctccagacgactggaccgaggaacgacggctgaaggagagtcgacgaagaggccatgccaggatgatgtaatcatctttgcagatgaagatgctcaaaaaatccaaaccccccatgatgatgttgttgttgtctcggcgacaatagcgaactatgatgtaaaaatgattcttgttgataatggaagctcgactaacgttttattttactcgaccttctctcgaatgcgactgtcgaccgaccgactcaggagagtctctacacccctagtgggtttcgtcggggaggccgtcacagtggaaggagaaattactctttccatgatagctgaggccgaaccacgacaaagcaccgtctacatgaccttcacagtcgttcaagtaccttcgacctataacgccatacttggaagacccggactaaataccctcagagcgatagtctcgacatacgacttgctggtctgattctcgactaaaaatggagctggagaaatgcacggggatcaacagctcgctcggcgatgctttcaaatctccactcaaaataataaatcgaaggactccctgtcggtcgacaagctggaccaacgggaagaggaggaacggtgtgaaccggttgaacagctgatttccatcccgataacaaagaatcctgaatagatcatctgggtcgggtcgtagttgttcgacccagagcgacagcagttgatagagctgttgaaagccaacactaatatattcgcttggttgacagcggatatgtccggcatatctctagaaataatgactcaccgactcaacatcgtccctggcatgaaatcggtgagacagaagaaacgatctttcacctctgaaagacagaaggccatcgacgaagaagtagacaagctgctcgaagcgggcttcatcagagaaaccacatatcctgactggctcgtcaatatcgtcatggtgaagaaagccaacgaaaagtggaggatctgtatcgactataccaacctaaatcgagcctacccgaaggatagcttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcttcgccggaaataaccagatccggatggcgcccgaggatgaagagcatatggccttcgtgactgcaaagggcctttactgttacagagtgatgcccttcggtctgaagaatgccggggccacctaccagcacctcgtcaataaggtcttcaaagctcaaatcgagtgcaacatggaggtgtacatggacgacatgatggtgaagagcgcacaggcttcagatcatgtctaagatttggaaaaaacttttcgcactcttcggcgatattggatgaagctaaatctgactaagtgcaccttcgggataactttagagaagttcctcgaattcatcatttctcagcatgaaattgaggccaatcctgagaagataaagacgatcatcgacatgcgatattcgaacaccaaaaaagaagtacagcagctcaatgaaaggatcatcgcgctcagtcgattcatttctcgatcgactgagagatgactctcgttcttcaaaatcctgnnnnnnnnnnnnnnnnnnnnacttgaaaagccagaggtcggagaaatattatacctttacttggctaccgccccagaggtggttagttcggtactcgtccgggagaacgagagtcgaactcaccagcccatatattataccagcaaagtgctccacgaagccgaaactcgatactcaaggatggagaagatgatatttgccttggtcatatcagtgcaatgactccatccgtatttccaagtacacgccatcgtggtcctcaccgaccacccctgagggcgatcctccatcgccccgacacatcaggatgactgacgaaatgggcgacgaagctgagcaagttcgacatccagtaccgaccgcgacctgctttgaaagcccaagttctgactgacttcattgcggaatgcccgacagtcgaccagatgtcggaagacgggagctccaaaaaagctgcgacctctgaatatgaccccaggtcaacctgggtgttacacatagatggagcttccaatgcccaagggagagaggtcaggttcctgctcaccaacttggagggagtagttaccgagtacgccctctgattcaacttcaaagcttccaataatcaagccgagtatgaagcacttctcgctggcttgagagtggtgaaggagctcaggatcgacagcctcagagtcttctctgactcccagctgattgtggagcaagtcaaaggcgaattcgaagcacgggatccgatcaatgcgaaatattttcagaaggtgagagatcttgtggcacaccttaagtatttcgaaatctcccacattcccaggacggagaatgctcgggccgacgcactctccaggcttgcgacatctgcctatggcactttgggccggacactcatggagagtctcgagcaaccgagcatcgacaaggctgaggaggtgctacaactgacaatcgagccaaactggatggatctgatcgttcagtatctgattgacggaaccaatctcgaagaccccgtggaagccaagcgactccgatggatagcctcccaatatgtaatgatggatgggcgactctacaaaaggtcgttctcccttcccttgctaaagtgcctgagattgacggacgcggactacgcactcagagaggtgcgtgaagggatctgcgaaagtcacctggggggcaaatctttggcctacaaagtcctacggcaaggttactactggcccaccatgaagaaagatgcggctgacttggtttagagatgtgagccatgtcaaaggtatgccaacttacaacaccggtccgccaactagctgactttcattatcgccccgtggcccttcgcccaatggggaatcgacatactcgaccctttccctccggtatctggccaaagaaagttcatagtgactacttcaccaagtgggtggaggtcgaactcctggtgcaaatcaccgagcataagatggaagactttatccagaagtccatcatctctagattcggactgccatacactatcatcaccaataatgagcgacagttcgacaaccatgacttcagagagttctgtgcgagatttcatatcacgcacaagctgacctcggttgggcatctacagtctaacgggaaagtcgaagtaaccaatcggaccattctgcatgggttgaagactcgactgaatgaagtcagaggcctctgggttaaggagttacactcgatcctgtgggcataccgaacgacaccccgtatctcgatcagagaatcttttttcaatttggcctatgggatggaggtgatgatcccactcgagtttgggctaccatcgactagagttgagcagtactgtgaatcgggcaactccgagtgtcggagagcagacttggagctcctacccgagctctgacgcgaggctcaactccgcatggcttcctatcgacaaagagtggcccgatactacaatgctaaagttaggccaaagtccttcaaacttggagacctgattttaaggaaggcgaaagtctcaaaccctcaggatcaagggaaactgtccccaaactgggaaggaccctacaagatagcagacacttgcaggtcgggtgcctatcgacttgagaccctggaagggatagccatttcccgaacttggaatgccgacaacctgaaattgtatcatcaatgaattctgtatgcccttgctcgaaatacaactcaatttcaaagctccagagtctacaaagtttggctctccgtcgagggtcggccctcgtcagaagtacgagcctcgacatcccgacttgggcccaacgtcttgttggaaacctatggttcgatcgtcgaatctatgtctcgatcgtcgaatctatgtttcgatctccgaatctacgtctcgatcatcgaatctatggttcgatcgccgatgatgcatcggactcttacgagaaccattctgtctacactaacggaaggccagtgctagtgatgaaacctctctaagttgaagccgcgctccttccgcaatcgactctcgatcaacgcagctagctaacttgccgacttagctttggctaagaaggacaaaatgccaagacgatcgcagtcgcacttgcgacataccgactcgatcacgatcgatcgaaggatattcaacttgccaccgtttatcatatatcccgatgtgcacgtccgaccaagggtcggacaatggatatttgacttgtcgtcactatcctaaccgaatacgtcggacaccactcgactatcagactcgacttggtcacgatcgatcgaaggatattcggtttgccaccgtttatcatacatcacgacgtatacgcttgaccaagggttggataatggatgttcgacttgtcgtcgttatcctaatcgaatacattgaatgccactcgactatcagattctacagaatgatcatgtcaacgagctacgctcgaagattgaccgacactcagcccaatgtgcatgcccgaccaaggtccgggcgacgaacactcgacctacagtcgggacggctctcgaccatcggatcctatgctatttgtatgatagtcgggatgccggcctacgatcggagcttgcactgcccttagcacgatgtatgccactgactactttgatcagctatgctagatcctaccgaatgtcttaacgaggtatgtcggagctacgacctatactctcagggatggctcggtgagacatatactttgaaccgcatgcagaaaaaagtttgaaaagtctttgatttcatttagtcgaagtgacttacaaaattgggccgaagtccgattacaaatatcaaagacaaaataaaaataaaagaatacaaaaataatggagcagacactccgactattcgtcagagtcgacttcctgcatcggggatagttcggaagcaatcgatgtacccgctcaggtcagagtgggaccaaaggttggagccatctcaccttcagcagctcgttccatcggcccagggtcggcctcctccgcagccgtcggatcctccggcattgggtcggcatccccctctgcggcttggtcctccgaccccagagggacgacgctgctcaggtcaagctttgggtgcagactctgaattgcatctcgggtgtcctcgtaccccacccgataggaggtgaagccactctcgagaagctcctcccggtactcatccgagccacgaaagtcctccatcgcccggctcaacacctttttggccgactctgcctccgccttcgctacgtcggcgtcggcttgggcggaggacaagttctccttggcctaagccaggttctccaagctaatccgaagttgttcgcgctcaacctcgagctctctgatgcagccatctcgcttatgccacagtcgatgaacggaacgggtcttgcactggacctgctcgcgagccgactgaagttcggcctccgaggtggctaggccattggtgagtctggaaatctcttcctcgagcctagcctcgcggtcgaccgacagcttcagctgatgcacaagcgtcgccttctcgacttcgacagtttcgaccctattcttccaagccgcccggaggtcgtcaaacctccgatacccgacctccagctcggacatattgtagatcagctgtaagtagaaggccgatcatcagaaaaatgaaatgatgaaaataataatgaagaaagaagaagaagaagagttcacctggatcatggtcaggtaaaaggaagtaagcatctcggtcaccggtcgactcttcaagagctcccgatcggtcaggagaatggttgcctgacacaacctcctagccaaattgtggttggccagggtcgacgctccttcggaaactcgaacgtcggacgatgcgacacagtccgccaaccttgtgtcgtccatcggcgccatcggaaccttcccccgatcagtcgcccaggcttgaagatcagagagagatgggaaacttgaactcgactgagttcctcccaagggtgcgacggaagccgccacaggtcgttcgggctcacgtgcttcggcccgaatctcttccataggcgggggatccgacactccttcgactgccccctccgtcgccccttcctcggaggtgcctcgagtcgcaccactgacgccgacagggcgatgaccggcttaaagttcgatgcccgttcgatgtcgggctgcactgccgccatcgcaataccgatcggggatgatgtctgaggcctcttggggggccgcgaaggtccggccctgggcgtcggtctcttcctcaccgcatgttgccgaatgtcggtgtctgtcagtcttactctcgacagcatgcctacaatttcaacaaaggattagcgcaagtccgaagatggatgaaaaaaatcaaaagacgatcgacagaccgaatagtacctaagcgaagaaccgaactcaggccagcatcgtacagagcttgctcggtgatgagctctctctgcttcggcatcgacacatccttcagtcggtgaaagtcctctcggtctccagcctccacccgactgttttcattcggctgagtctgagggtcaccccagtgagaagggaacccccaatgtagcgaagaagaagcaaaaaaaaaatggttcttctatccgtggattgacgatggaagaccggtaatgaatgaaagacccttccggagattgaagaaccaccaccttcaggctttcaagtggggtcggaggatgaagaacgcccaaaagagagagatgcggggaaagatcggcaaaagtcgacacaacaaagcaaagctgattattaactggactgagttcggtgccagttgcgtcgggcaaagcccgtaataatccaagaccttccggacgaacttcagaatcagaaagcgaagacctgtccgaaggtcctcgacataaaaggccacctggcccggaggtgggttgttaacccgaccctcagccctaggggcgaagagttcgaactgctccgggataccgtactgcttcctgagccgttcgacattcaacctcaaaagtgaagaagcctccacctttggggtcgaccgagaatcatcggtcgggttccccgactgacttcctcgaggagaggttctagccatatcgctagccccaaaaaagagaacaaaaagaaaaatgccaaaggagaaaggatacaaggagacaagaatgaaaaaacttcgagaaaagctttcgaaggaggacaaaaatgactatctgaaactggaagacaactcgacagagcctcagcgccagaaatcggacagcaaaaagtgaagttttggatgtaagtggccgcatatatataaggcccttcgacggtcgagatgaaagcacatcaaacgaggattttttggatgtcgacacgtggcagcgcctgggcccttcctcgatccgatggttcgacgcatctgtcctagatcgagccacgtcgcctccatccacgtgagcagttcaggcccaatagccccctgacacgtggtagaaaaatcgcatctcagaattaattaaccgacgacggtttgtattcccaatgagacgacggtttgcgttcccaatgagacgtctaacatcggatcattcgttgatacggtcaccagagtcagagcatgacatgatggaaaaccactcctttcgcccgaagccgtcgcccacgtagaaacgtgggccaacacgacatccgactcaagagtggggggggggcaactgttggaatatgccgactgacccctgtacgccgacttaccctcggatcggtccgaccgatgctcgactctacccaccggaccgacggaagactccaacaatgactccgataatgactaccgacaatgactgttgacaatatccggccgaaggcatgccggtcaaatagaccaatactacttccaatcgaccgaacggccgaacccacatcaccgactcactgtcgggggtggcagccgacgtccgactttcacaaggcaccagatcagccgacggtgtctccgagtcaccacccgatgacttggcagccgaataccgacatatagtcggccaacccatccaaacgctgtacaaccgctatgggccgttgccccgttagggacatgcggtacgaccaccctagggcattgcctgtcaaggacatggattaattccaatgacttgacagcccacagtgatttgacagccctcgatgatttgacaactctccagctgtctgcaccattaatggcgggatcatactgcattctactataaaacagggtaagacaacagttttggtaagcacctttaagctcttgagctctctagctctctctctctcctcggttgagcccctgattttctactgttgcttagtctcctctctgacttgaccgtcggagggtctccgtcggaggcatctccggtcagtgaggacttttcttacaggtgcgtgaccccgacgatcagatgacggggggattggccgcaataataaccatcatagtgtcttgattgagtatcaaaggaataagatatttgggttggaggtgactcagccacagttattcgatggcttactttttctgttgcttctatgtttcagggcctttacttaaggatctgttcatgtggaaggatttgcttcaaaactttcaggcgactcatatttttcgagaaggaaatatggcagttgattatttagcaacgtttgcggtattgactgatattcatataacccctcatggtccttttgattcggattttactcaaattctccaagcggattcttggaaaattctttatgaacgatgatgatgccggtcttcactagtgttgccctgatgccttatcttgatcgttgctttcagtgtttgcccccagatcagctttggtgcaaatgtaacaggctgaaatattgggtggtgtatttgcttttattgacatatatggattttgagttcattgcgtctctaaactctctctataaagcttatttttggttctttactgttatggagatggggatttggacaaaggagtctgtgcaggagggtacctctctgcctgacgcctggtcttttactctattttgcaggttgttaaaatttatgttatcaagtggcgaatataaagttaaattctcaggttcagcaaggatcgaatctcctctttcctattcacattttatttgttccagggattgctctgttatctggtctgggtgtgcatgctgtaaggtgccaatttcagcatacctcttaaattctttgtgaaacctgtattattctgtgaacttttttgcagggcctctcatcgcttctgctggtaaattactgtcggggtttatttggctttcgaagtatggtgctgcagtatggaatgctttcctttatgcctgctactatctgtatttgtatatcttaaacgccttctattttaaacttatgtctttgttttcttttgatgaacttgtcctgggagtcccaggttttgtaatttgtgttcttctatcttaatattattgctgtggccatttggctcctgttaccaaaaaaaaacaggaataagatatttgtgaggccacatggcgacgcgatgaagcaccaattctatctttgtttttttttaattgaaggggaggcaaagaccacccataatcttattaaaaaagagatatttacagagaaagaggattacaggtcacgcaaacaacgtaatagagtaatagacatcagcaaaattgaatagaataaagagaggaaagggaaaaacagaaataaaacaaaacagtgtcgtcgccaattttcttgtaatatatggaagcaagttctttgttttaggtctcatgcttggtccccaaacatacttggcattgtaaaacatcaagtcgagaatttcttagaaatgctgagcaatagctgcaacttgttaaattggctcaaagcctaccaaattctgcctccgcttaatctggtacggtccctcaaaacactcacccacccacaatttatccaaaacccacattttgggcttcgcctacagcctaattctcccttaggttgcgtttggtgcatcgccagataattttgaaaggtaatatgaattatctttagaataaattatcaccattaaattatcagtaatgttgattactgtgtttagcatacacagataatattacatcaaagtggtggggatggatatggaggagccacagaggggtggtgtaggacaagggcagagaagccatgagcaaacaaagggaaatggaggagccgtcgatcggagatgcatgcggaggggggtggagagagaagggagggctgggcaataggttttgtgtgattttttcgaggaatcattttgtccaaaatttttattacaatattataaaaaaaatgataatctggatagccattcttccctaaagcaatccagattacctctcatgagacaatttggattgccaaggcaatttagattaccatccaaaaagcatatcaaatgcagtaatccagattatcatattaaattattagtaatatggatagattgccggctatcaaatgcaattttagccttttcgacgcacttaggcccgcctgactcgaccttgacatgctcaaaggtcgagttggattcaaggtaggcccttggatttgataatggagagcggaaatccactcatcattaacttgagccaactcattgcttggttacgtaacctgcgcttcatccgccaaactttacttttaccgtcgtcttcaattgtagacgagtcgaaagcttgaaccagcgggtcacttggattgcggaccccacactcttatccaagcgctgttcctcgccgcccgccacctgttcgacgagatgccacaccgggactcgtcacgtggaaatccttcttctcctgctctgctccgccgagcccccgacccaccttaacctatgctgatcgagttccccgacctcttttcgatgccacaggccgttgagcagtgtttttctccatgtttggacttttatgcgatgattggtataggttcgatggaatgcctgaaagaaatgatgtgctgtggatgtagttatcaaaaggtacgcttcaaatgggtctagataaatatgtgtccatagaattcgggattaccaaagctagcgagaacggcagacgacattttggcttgttttcttttgatgataaagaacttgaacgcagggcacgacaggtgatatttgcagagcgttttggcgttgacaagcagatgcatgaaatggccataaatgaaggatttagccctgattgctctcggtcactcgcaaataatgttaattttctggaatcgagaaccgagtgtatgcatgaagagctggctttctagtaaaacccaaataatagcatattttcccatgaatttatgatagatcatggtaaaaatagtttcaggaaagcgagtactgaataatggttccacatatttgagacatacgtgcaagtttttgtgattgcaaatggtttgactagttttagtaatttccggtcaacggtatggatgatagcagcgttcaattttttcaacttgttcttgggacaaaaaacatatgagtcagatattatagaatatcatgtggggcggacttcatagtttgtcatattttaatatcaaccttaaaaaataagtctaaaaattaaaaacttttctatgaatagagttactagtcctataatttaaaaaaataatatttttatttttttatattttcaatacatattatatagttatatgatacatactaaataaatcaatcattaaataaatcaatacacatctctaaataagtcaatatatagtttttgaaatatagagtttatcaatatataatactttgctagatgagacataatggtaaattatttatctaacaattcaatacatgtctctaagtaaattgatgcatagtttttaaaatattatgtttactagtatacacacatagcctaatgatatacacttattaatttattgatatatactataaatttttttgatacacatccagtagtgattctatccatatctctagataaaaagcatatcctataaattatatattaatttatttaaaggtatgtattagatcgttgctaaatatatattaaagaatgtaatatgtatcaaaaggtcaatgcgtgtgcatcactatacaatgtaatattctgaaaattatgtatcaatttgtttggagatgtataatgggttactagatgactaatcactaagtatgtatcaccttccctatattatatattattatggtgtggaaacgagggcatctttagttccatattgattgtgagtcaagaaaaattctggcttatataggagaggaccatccttcccatatgaggcatattttaaggggtaaaactatgaggctcaagatagttagaggcctaagggcccaaaatagtcaaaggctaaagtggacaatatcttacataccgagctatgagttcttaaccgcaacagtggtactagaaggagggcaccaccctctatggactatggagctcctcttgtctgtacatcaatctatgggaactgattttttccttatcgagggggctatattgtgatgtagaaggaaggcatcattagttgtgaattaaaaaaaattctagtttatataggaggggaccctttctctacagtgagaaagaccactttagctcccacgcacatctctggagcaacgcgacctgacccgggctctctctgagaagctccatattttttctatgtaaggcaccttttaagagataaaaccatgaggtccaagatggctagagacccaagggcccagggcagtcaaaagccaaaacagacaataattcacatgccgagctatatgagtccttgaccgcaatatatattattgaacttcatgctctaaaaattatgtatcgatttatctaaagatgtatattggatcactgctaggtatatatcaaaagagtttatcttatatatcagaaagtctataagtttatatcaccatactatgtagtaagtattggtgaatataatattctcaaaaactatgtatcaatttatttggagatatgtattagattgttagatgattaatttgctagttatgtatcatatagccatatattatatattgatgaactctatgttcaaaaaattatatattgatttatctaaaggtgtgcattgatttgtttgattattgatttatttagtatgtatcatttgatcatatagtatctattaataatatacatattatgaaaataaggaagaaaaaatatcatatttttttatttttagttatgagatcagcgactctttagtagaagaaatttttgacttttatatttattctttaatattgatattaaaagaaatatgataaattataaaatccatctcatatgatattttatattatctgccacatatgatttttgttcttaatcttcagagattggattgaagagatgcatgttaaactttgcttttgatgccatgaaaatcttttttgatgcaaatttgatggcatgaaaattagccatccacagtatcccatgaattgctttctttggtttcacttggaggtgcttgaaaattgagcatcccgggggtcaaagaggttcaacctacaatgctacatgcatgcatcgaaaaggattgttagaatttgacatctcaagattcagtccacattgagcccacagcgagattaacggcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgacggtctgggatgtgatttgggttgattaaggactcctaaacctaatctaaaccctgtttaagccctttaaaagctctgtgaggcaacagagaaggtatggggtttggttttgcactgtggatgccatacggaaccgaagaagaagcgtgcgttgctgagaaaggagcaggaggctctggacagcggtcgccaagcacttcaagggttcagggggtctttcaagagagagagagcttttgagaggaaaacttctagagagagagaattgggtatacaaggattgagggtgaggtctcctcttgtaaaatttttttttcatagtgaagtttgtatgccccgtggaggcgagcccttttgtgactgatccacgtattttgattgttttgttttgtttcttctttcttcctgctgcatcgcgtggtactaaaaagatcttgaaaggtggtgtccagaccagacatccacccaacaaggattaactgctcagtgccaggaacactatggatgccataatcgagtaccacgtggcttcgaattgaatgttggaatgcattgttaggtgctctaattgagatcagttctggaagttccattgaaatcctttgtggcgcatgcatggatgcaccatggagtactaggaatttctagataacttttagatcatttcatttgatggatgtctatcttctaatgacggttattcaagaatctacaacactctagagcacagactgtacactacaagcatccatgctctggaaggttggaccatcctttgtcactttcattatccaactgcttatgttaaaatcgttgacacaaaccaaaatccttatcaagacaagcatatattatctttattaatacattgttatcaatacattatctttataaataaagagccccagctaaataactgctaaggtcagtgacatgggtttgtaatttgagcttgggggctacttggtggccagataattgtgttaagattaggaacatattggtgatattcttaccttaatagtctattcttttatggataaaaatttatctaaaaatttatatttatttagataaatatttttcagacaaaattagatagaaaaataatttatgcatatttttttatatatgagaaagtggcttcataatctgttatctatattttttgcattactatttttctggataaattactaaaatttatccatattttttataatattctttatgctttttaggtttgaagaaagtggacaagtgacaactgagttattaagcattaaatgctagaggctttggaaatgagagtgggatatcttagaaataaaattaaatatctattttactagctataaaaaaataatttaccaccccctaagtggataagattttttttatttcattgctaaatgctatctataggaaagtaaattttttattttgaaaaatgtgagaatatggataaattagtcaataaaaaagttgattaactttttcatgatatttacttacaaaataataggtcctaagttcgttcttttgaggataaaaaattatttaaaaaattatattttttggataagtattttcttaacaatatttagataaaaaaataatttatccatattcttttatatattagaaaatggcttgaaaattttttatctatgatcttttgtattaccagctttctgattaagttactgttgggacaatcgaatttgctccccccgattctacatcggctcccatatttgagatcagtcctttgtttcctacctatataagaagagccaagagatcccaagaggaaaggctttggaagagaaaaaactctcagaattcagctctcatgagagtcatctagccgaagcagagtcattatggccgaaccagagtcatctagctaaagcagagtcatcatggttgaacttgagcatcatggctgaagcaacatcttcatggccgactgaccatctgtcatagttgactgaccatcttcatcgtcgattgatcatttttatgtcatggctgactgatcatcttcatggccgactgatcatcttcatgttatggccgactaatcattttcatatcatggccgattgaccatcttaatatcatggttgattgaccatcttcatggctgaatgaccatcttcatgatcaaactagcatcataatggctgactgtcaaacaaccgactgccgactgtcaaatggccgatcgtcaaatggccgattgctaaatatagaatcatgatattacaatggtggataataactacatgccacgatcgttagtagatataaattatctactaactccatgattatggcctgataatcagagtaactatcacttagtgtcatacaaaatagaattacatgctcgatggttacacccgagtcacttgtaaaggggagataagggaatagacaaggggtaagatacttatgggctgatactttatcaattttgatattttacttcatgttcgatcacttttcactaacttaagcattgaagaatctccatcggatataactctggtcagtgtggatttcttttgcagatgctcttcatcgacgtcagatgcttcaggggattggccgcaacagattggcacgtcaggtagagaggcaaacaaatccttaaagagcaatggtaagagaaaaaattcagaagacatccatcaataatggctgacgatcttctcatgggaagatgctatctgagcaagaacatagagctccatgctccacagtaacaatcaagggagccccaccatccttgatcgctccttcaaactgcaccgccaattattggctaccttattttgacacagctaataatcgatgatggtataatctcgaagacagtctcatcggagggattggccacaccactcagtccatcactctcaatgcatcgatcgctacctattccccctacaaagctgataagaaaaaatgacgatatatatttagaaagcttcttcaaacaatgaatcgatcatgattgatgattctgaaagcttctccaaatgatgaatcgatcatgatcgataattttgaaagcttctccaaatgatgaatcgattgtgatcgatgattcgaaaagcttctccaaacgatgaatcgatcgtgatcgatgatacggaaagctccttccaaataatgaatcgatctagatcgacgatttgaaaagtttctccaaataatgactatactcctctataataaaatgacttacgatcatgttttggatcaacaaaacaatctacaataatattcttctacggtggaacaattgtccttcaaacatggaatgccaacaatctatgactgtatcttcagtaaagttatccttaagacataatatattcaaacgacatgttcgatttgcaatatactttcaattgacatatgatataatgagctccggctcaagatgattcgacgataaatatgagctccaactcaaagataattcgatgataaatacaagctccggctcaagccccgaagggccaaagcagaaaaatatcgatctcgaaatcgaaatgagtcccaagaggactaatatgccaacttgactacggtcgaatggaataatatgctgactcgatttcagtcggatggaacaacataccgacttgactatgattagacgaaataatatactgactcgactccgatcggacagaacaacatgtcgactcaattttgatcggatggaataatatactgactaaactatggttggatagaacaatatgccgactcgactacgatcaatcgaaagaatttgccaactcaactttggttagtcagaaaatatttaatagttatctatgatgaatgataatcacatcaaaaagacaacacaaagaaatttttttttcactatgaactgaaggcaataaaatcagactaaggtcgataataaaagaaaattttctttcattatcaactaaaataaccacagaattagaactcaaagtcaagacagaagatacaccgactcctatcatccaatgcattaagccatcttaaacttgagagtgaggagcaactgttgggacaatcagatttgctttcttcgattctacgacggctctcatatttgagattgatcctttgttccatatctatataagaagagccaagagatctcaagagggaaggctctgaaagagaaaaaactttcagaattcagctttcatgagagtcatctagtcgaaatagagtcattatggtcgaaccagagtcatctgaccaaagcagagtcattatgactaaacttgagtcatcatgactgaagcaacatcttcatggccgattgactatcttcatattatagccgactgaccatctttatgtcatagtggactgatcatttttatgaccgactgaccatctttttatcatggccaactgaccatcttcatgaccgactgaccatcttcatatcatgaccaactgaccatcttcaagatcaaaccagcatcataatggccgactgtcaaacaatcgactgccgactatcaaatggtcgattgctaaatatataatcacgatactacaatcgtagataataactacatgccacgatcgttagtgggtataaattacttactaactctataaatatggcccgataattgggataactacaccttattgtcataaaaagtgagaccacgtgcttgacagttatacccgagtcacctataaaggggaggtaagggaataaacaaggggtaagatacttttggactgatactctatcaattttgatatactacttcctgttcgatcactctctactgatttaagcatcggaggatctccatcgaacataactctagtcagtgtggacttcttttgcatgtgctcttcaccgacgtcaggtactccaagggattgaacacaatagttaataagatctatccttatttttcataatactctttattatataaatattattatatataatagtataatatgatatattatattataatatattatattattataatattattataaagttaagagtatattaggaatgaattaaaaaaaatattttttcaattggtgaaaaaatgatttagccatctcttagatgggtaagatttttttctatttcatagataaatactatctatgaaaaaataacttatctatcttaaaaattatgaaaatatggataagttggtcaataaaaaaattgattaatttttttataatatgtattcaaaaaaatatatgctcttatagataagttactttttcatggataatatttatccatcaaatgatgaaaaatcttattcacctaaggagtggctaaattactttttcattaactaaaaaataatatttttaattcattcttaatatatctttaattttaaaataataatataatataatataaaaatatattatattatgatatagtatatcataatataatataatataatataatataatataatataatattatataatataataataatatattatattattataatatattataatattattataatatattataatagtaatataatttataatattatattattatataataataataatatttatatcgtaaaaaattttatagaaaatatggatagatcatagcaacttattcagaaaactaataacacaagagaacatgaataacagattcccaagctatttcctaatacataaaaaaaaatagatatattattttttatctaaatattatttgaaaaatatttattcaaaaaaatatagatatctgaataaattttttatcttcaaaagaaaggctcttttttgcctagaaatatatctttttctggataaatgtcagggatctatatttccttcttataagtttaaaataagtttttgcttttccaacatttgcaattaaagtggaataaacagaataagctgatctttatttctttcaatcctccgtgaactattatcaaatgtatcccatgtttttaaaggcttattagtgttgtgttagttaatcatgtgtctatagattgtttccgcaataaaacatatgttacaacaggataatctattgttaccttttattttttatcttttatatataaggctgaaaatgggcttgggccggcctaatgggcttcgagctggcccaactacaggctgggctctgggctaggcccaaataaaattaggccgggattgggcttagaaagattgcccatttcatttttgggctgggcttgggcctatcaatggactacagcccgaccagttcatctgcagctcctacatccgtctgcttcccatcctccaccgcctttaccgcttgatccatgacctccgctaatgagctcttcatcaacggttagatccacctcatgaagctctcctcccagctccagcagccctaggtccttaccccgctcctctatctcaacaaaaaagacggtgacgatacggctgactgtcacccatcgaaaatcacccctagagttagagatttgaagctccgaagccgatcgatccaccagtaggccagattccattccttgctttggaacacgccggagaggaagaaaccgcgatcgatccatctgcgggccaaatcccattccttgcttaagaatgctgcaggcccaaatcctattgactgaatgcgacgaaacacgatgccggagaggaagaaacccatcgaggggctctcactgttgttggcgagctggagggggatggcggagaaggattcaaagcttcagaagccggtggcctgtgattggacggcgacggtggcagggccattgaagggggtggagttagcagagacgaagtgccagagatggccttgaaagcgatctcagcagtctcgatggcggcagtgtggaggagagggagcggacgggcatgagctagggccatatcatgttcgggctggcccaaatagatttaggccggtccaaatagattcggaccgagctcgggccgaggctcaggccaggctcgggccgggatttttaagcatttatcaggcttaagtctagcccgaagtttgaaaataatttttgggccagacttttcgggcttcgggctcgggtaggggtaggatccggcccaacccggctcagttccacccctatttatatgtaacttttttctagtatagttagaagaataatccttgctcatgaatcataaagctattttatgctcgaaataaggttgaacaatatctcaccttaactttctacgtacctaacatttgtcatggactgggttctttagaagtgctatgtttgaatgctattagagaggagcgcatggccatatatctgcatctgagtgcagagaagccatgctcttctacatcccctaaagcttgtttttgtgtgcttttaggattaaaggagtttcagcaaaccaacgagggaatcttatattgaatcagtgtaaaatgatttcagtacatttttatcatccttcctcctctccttcgtctcttgtatatgctaatataaaagctgtattcaataaataggttagaattccttaacccttttctcaaaataaaggctttctacaaataacattgttactttgtgaaggctaatatttatgaagcacatgctgtttggtggataattaaaatgtcttatgggattacaaggcaataaattaaattcaagaaatttcaatctgccttcgctccaccttaattataattcactatagaagccttccgatgcatgcagttcacctcggggttgaactcttctcttctggaaatattttatgtctaagtaaaaagaaaatttcatttccaccacaagagtaacatagtatgttagtggcattgcagtttacctatgaactaaaaaatgtctaagataagcgagccactttaaatcttaggatcataaatgtaggaaatgatgagagaactaaattctagtctgacaaaattatgaaatcatgaaataatatgatgggttatcagacacttatttggatttttttttccaagaattatgcacaaattgctataaataatttttttataacaagaaagaaaaaattgttgggttggtcaaactcccatctatgtaattgatccattttttcttaaagtttgtgcagcatattttgctccaatctctactcgtctatccacaattatgatgcatcagttttgtcacttttagaaatggcgttggatggtatggttcgatggattgttatctatactcatctcgaactaatcttatgataagaatggatggataaaattataaagtcattatttttatagataaatcaaataaataaaaaaatataaaaataaatttcaagatttcatgtatattaaataaaataaaaattacataaaatataataaactaaaattttaataataatgaaaatagtaaacaaaaatatattaaaaaattaaatattatttacatcaatcaaataaaaatagaacaattaaacatatattttgtaccctttcatataattaatttttcttatgatcaatcacaatcttttttccttcatgatcattataatcattataaataatttacattttgctatcttaaaaaaaaaaaaaagagagagtagactccataagttagtaatgtacataatataattcggatatgaaacaaagtgtaggaaggggtcgatgggcatgaagctcgtaaataatcaggtattaccattatctatcgtcacctcctctctgaataggtcaggtaggacccactctagtaggcctgtcgagtgggttacacgtgtaaagtggcacccttacaactttagctgtagtttgacacaggccccatagattctcaccatttgcttatacagcacatacaccgtttcccaaacacccttttactaaggggccttttatcttctctccgagctttggacggtccgtccaaaaccctaggcgtagccatctcggcctccttctgtctgtccctcggtggagccatggggttgctgtcctggtggaagggaaaggacgcgccgtcgcctccaccgcaaccggcggcgaagggcgaagcgaaggtccccggcagcacgaagccggcggaggaggtccccgggatgaacggggcggtggaggtgcggcgtccgttggacgtgacggtgttcgagttcgggtcggcggcggcctccggcgacaacgtgacgttggccgggtactgcccggtctccgacgagctcgagccgtgtcggtgggagatcatcccggccgctgggtccgacgccccccagctccggatagtcttctgactgttggtacatcttgaaaaaacactcagaatctatctcttttttaatgtaaaaagaatgtgaaattttaagatcactgacgatgattcgtgcatcagaatacatggtttgtgcgtgaaattgttagggtttccttctttgttgatgcgaatttcggttttggcttgatttttattaaatcgttcttaactgatggatcaatttcttgaaaataggaaattttgcattgttcgacttaattttcctgatttgttcgaaacctaaagtactccaccctatcccccttgatgctggaactaatttaacaagagaaaactcatccagcaataatataatcttttatagagaaagtgttgaagctgatatcaggatcaagttccaaacttgttgtcaaactatctgatggataaccagatcttataaataactgttctgcaaaatcttatatgtctgtatcttcgaattttaaataagaagttggcaatcttgatctcgacacgaagggcgttcgattttttggttctagcacgttgggtttccttgtggtgaaaccgtatgataaatgtctattgggtgttgtatccagttggtattccgaaacacagcactaaatggttgggcttggtcagcacttgaggaacagagtctggttacaccattgataagcatttttttaagactaaaccgtgcatttacttgagcattctcaaatagttatttacttatcttgtaggctttttttagtgaagtaacattcttatgtttgctgagaatggaaaaattgatggttgtgcagaatgatcagatgtgatgattggtgatgatggatgattttcttcttttcccctatttcataggaataactccagttttacatatcgacaaaataaaagttgtatttttaatactggttattgtgacgttgcatattgaatacctacttataattgtgtcttatgtattttaggttcagtctatagtaggaagttagaaatattttgtattttgactgtaaattcatgacgttatacatattggagagatgatatctgttcatatgttattgcccaattatcattcccataagaagaccttgggcaccgctcttgtagcttgatttatattagattcacttctctttgcttgggaattttctagccattatctagttggtttcctcccctgcccttcggccagcattccatgttctctgttaaggcatcgtcacttattggaccaaacaagccccgttgctggggcacttagatggtgtttttatcagggagatgttcctgtttcaatgtcatcatttcctttttgattatgctgatgcagggctgcatcatttgcaaaaaggtggcaactgtagttaagaaatccagcattcgatgccatgaatttcctggagtcatgtcaatgataatcttaaaagttgatcttgcttacgcgattgacgtgagattacagttactaaatgggacaagaaacgagacctagttatcggctctgccaaagttatatacattaggtgagtcatacagttcagtagttctaagttttgtttatttgagattaaggtgtacgaggaattaaaacatgccggtatggccaaaaattaagcacccaatgctataaagattgccaatatggatcaaacttttgcgagctatgcaatcatctggtgtgatgtcttagagatgcaaggcgtgagagaaaaaatgcttcgtctgatatggaatgaggttgagataatttcctagtttttcatatgtattaatattctatagaacatcatctatgcttgacaagcaagagttcactttgtagtggcctatcaatcagagacctggagcaggatgatcggtgctaacttcgttgccagatggctcggactggcacgctggcaacttgatcaacatgtttgcttgcacctaatgtttgttcctctactctttgcacttactgtatgattagataatcttgatccttgtgcaaggaaaaatagagaggcttgaatttatagcttatgatcatgtagcttggctccatagtttaattagtaacatgtgatggagaacacctcaacaatgccagggtaatcgttttgtgtaggttgacagaaggaggcacagtgcgaactttatggggtggacagaaagtgagggtgttggcgcacccgttcatgtgttaaaaaagaatgttaggatttgatcttgagaattccatttggttcagcaaacctaattagtattgattaaatctgcaccatactagcatgtacccaatttcctcaaaagctgtattctccatcaggtttaaccttgggaggaagttgccagactgaagaaatagtgttgcgctacccccatcctgaatgcaactcttgtaatgctggatttatgtagtgctgagtatcgtgtgtcactggaagttggtggcaaagtgtcgagctagcatttttaattaaaatttttttcctactatttttgtctgaaaaaaaaaaaaatgttaccctagtagcctggtatgttggccgatattgtctcttattatgatagcaatccgatttgtaatttttaagcaaaatatataatcatataaacatattattagcttgatttatcatctatttcagtaatatctttggttctgtagtcagaaaatttgattatctaagttatatttataattatattcatacttgaagtatccaaattgtatccgtatctgtttataatcaatatggatataaattttacatccgaataatatctatatttattaaataaaataaatgtgtatgtgtatattggtatccgattcagtttcagctctaattacaagggagggattttttggtagaatgtttcagggtttttgaaatgttggaaacaattgtggataatttgaaaagaattgtaaattgaactatgcaaaattaatgaaatttgctttaattcactagctttaacagactttgttgctgccctgggctaatttaatataaatttgaattatatatcgatcctagataaatttataaaaaaccacccttcctgtttcttctcatgttcatctcccggaattaaccgtagcatctacctgccacatcacagcaaacgaaatggcagtcacccttattgttaccggaccattcataatgtaatgagctctatcgaaaggatggtcaggatgacatctcaaccgcacatggaccgcagaggatgaaatgcaatattggccatcggttgtgggcaataatagatgatatcgatcccacccccaattccagaagataggatcgactgcgttttgcttaccctttaataatgttggcctccaatctcctcaaactccatccttctcaaactactctcaaatccccacctccgatcctaagcttcaagtctcttctctctccacctcgctccattccttttacacaccctcacctccctctctcacaaaagcccttatgcagactgactacctgctcgtttcacccaacccaagaggcctcttccacctcctactccccacccttcaccaaagaagaagcaatctcccaggccaagacctgcctctccaccaccttgcagaaacccctcaacaacccaatccccctccccaccaggaagctaaagaaacagcggcagcccagataccgagtcgagataccggtcctcgatgagtcgcccgactcgctcgcgcaactcgccttcaacttcttctcagaccttcccgtcaccaaaaagggctctaaaccaaacatactgatcctctggtccactccaaaactagccgaatttgcccaacaggctttcagcttggtcgactcggtcatcaactcggacttgggttctattacttctgaagtcctgagttctggcgacttggcggtgtttttggcgccggaggcgtcccaggtggaggagataagaacggtcactaacggtctgaatcccaaacccgtggtgttgttcaaccccaagtgggggtttgaggaggagaaggacttggatgggggaatggggagcttcgtcgggtctttcgacgtggtgtattcgttcatgggattggaggtgagaggagttctcagcagaaggaagggtgtggtgttcaagtgtgtgagggatggggtgttgagtggggaggggtgggtggtgatggtggaggaggaagggaagagtggggagttgaaagtggtttcgaggtttaggaggcggccgtccatcggcgaggtggagagcgttctgtataatctcatggctgccaattcccctgtgaccaagtccgtcaagtttcttagagatctggcatcaaatgtgacgggaaagaaggcaaggaagtgagcttttgtttctgtgaaaattttcaggtttttgtgcaagattcctgtcactgtaatcgtgcaagatgtttggtcgttttccagagtaattgacatttgcactcgagtatgaccaatctcaatgttgaatttctaatgcgcatggatttacgactgttttgtttatggattttagtggtcatgtttatgtgttcttttatgggtttcagagtatggaaatgataggctgctgcttaattgaatgactgcaataacattgacgcatggttcacttataatgttagattgagtctccagaaaaattatgtggtcctagcctgtgaatgtatgcacacacacacacatatggcttcactttatgattttataaattttggctttgataaacaaggagcaaaaaatctttatggtcgcttaacggtctgccccctccaactgataattttgttttttcatcttactcaaaatgaccatttatttcaagaagaaagtagcatatggcaactcttttgtaatactttaataaaatgtaagaaaaatgtatgataactagtagatatagaagttttctcatcacctgaaataaatttaagaataaacacaaatgtcacaaattataataaagtccgtctccattatatgatagtcctttacctttaagaatctgccagcatgatgccatctcgtagatctagtatcgggggcagttgccaacaaccgtatgatttgatttgatgcactgcatcacagaagttttttcagcaacaatagtggtttaactttgacttcaaagttcatcattttggtactaaatttcgtatggttattatcttattacagcattgttatatatatatatatatatatatatattattattttggtaaatgatgaggaactatactaatatctgttcaaagtttatacaacagtgagtacagaagcccaaaactggatcacacccaaaaccagaacaacatgtataaaaaatccaacccaagaaaatccaactattcaaagtctgtccatatataccaacatatacaacaggaacccaaattagccaaagaacagcaacatctttgaccaaaaataaaggccaccgagaaagtgaagcagagatacagagtagcaatactccaagatccaccaacatgagccctaggcacagtatagatatttgagcagtagagcccttcctgaaaaaagcttcagttgaatttgcctcccacaaatcaagcaagacatcaataacaccataaccatagaacatatgtcccttcccatcagtagcagcttttattgacacatcatttgggaagtaatagtgaaagcagcagaacccatataagtcacagaatctataccaaaaacagcccatttgcacttcatgcgaaaaaataactggaattgcatgtggagcattccaattatgatgcccacttatatgattgatgatgaacatgtgggctaagtgctcactcccatcagcggatatgtatatttgatatggtatctaattcggtgtaccaaatgtcaatacactctctgaatcatatattggtctagtatcaatatatggtatggctgatatgtatatcgattggtacagcaagttttgtttggatgttggtggatcgaacagtggggtgtgtagaaatggcagattagagcagatccttttgggcaatccatgagcaatacttggatagttgtggttgtaaggctagacgtctttcattaaatcccaaattggagagcataaactctgtttagcataggtacaaaactgagagaatctaaacccttagtaaaagatattagacggtaaggcattatttttgatgggagtcgtgtgtagggatagaaatagaccaggcggcctgtcagggcctatggcctggcctgatctgacctatttatctaaataagctaggtataggcttttaaaaaggcctgtttaaataaataggtcaggcctaaaatttcaaagcctggcctgaaagcctgcagactggtctgtataaattatatatatatatatatatatatatatatatatatatatatatatatatatatatatatatatatatatatatatatatatatatatatatatatatatatatatatatatatatnnnnnnnnnnnnnnnnnnnncttacccatcaatatccaattaagccaaaacctggcctgatctggtctattttcatccctacttttaaataggctttcaggctagatcaggcttttttattttgcaaaacagaccaggccgaacctcattttaagtttgaaccagtccaacaggtcagactcaggctaatattttacaatacagatctggtctgtttaagccaaagcctggcctagtctggcctggcctatttccacccctagtggtgcatacgaagcaatttgttattcacagtaagaagaaaccaatcctatgcctctaaaaagaaagagcgttgttcaggaaattattcaaaaaccttcctaagagaattgtaatccttggcatgttcaactttttgccagcgagatcaatgtgcggctcctccttttcggcaaggcatgtgcggctccccccttgagaagaagcagacagagcaaaataagaagatcacatcaagtggcatccggaaccactgcaaactttccacagcgaaaatatgatgcctttttaaataagtactactaggtctcttcacaaatctccccgttccattccacatatttgaggcagagggacttgatgccatgttggacagggaatggagggggattatagccgtacagtataccttttcttcggggttgggaggaatcatttgtaaagctggaacctacctcaactgactgactttaagcattttgagtctcaaatgctccctctttgttggagtaaaccaactgctctccgacatacaccgaccgacatccgattctgacccaccaaacaaatagacaattctggaagcaattgccaactctatgtcggctgagcagatcgacgctactctcgaccgaccaaccgaacatccctcaccgaatcaagatcgctaggtggctgatattcggactctacagacaataaattacttcggccgtcggtatttcaaagctactaaccgacaatcgacgcacagtcggccgactcattcaaatatatcataatcgtcatggacggttattccactgatactgcggcgtaatctatgaagattaataacccactacgagattatcaccttatgattctacgccgctaaatgcgggactatatccgacagttacgatgatctactttataaaaaggggataaggcaacaagttttgataagctaatttttgatacgctgagctctgtctccgttcctattcttttgttgccaaatctccttctgacttaagcattagaggatccctatcggaaacaactccgatcagcacggactttattgtgcaggtgttcgttcccgacgaatagacggtgaggggattgacagcaacaaattgacgtgccaagtaggggcaaacagcggccaaaagaaaactcgcaatgatgagaatcagagctcaacgatcaatggtgaccggcttgacaagacactcttttcgccgggaagaggctcctcccctgcctccggtagcagagcccagttgtctacgcttcgttgttaccacagacgctcggattgctgtgatcatgcaacaaatgaatgtccttatggaggcagtcaaaaccctccagcaactgcaaacccagccaccacaaccgtcggtggagcaactagtagcgcattcagcgccttccaagcatagccatcatcttctgcgatgatctccgtctcctctactagagcgacgatctcggctctctcaacgggttgagcagcggcactcatggcaatctcgacacgccacccaccattcacggtgcctctcttcttcccagttagatcgagcaaggaaaggaaagcgatcgtgaacaccatctgtctctaattcattgggaggatcaacccttggagtctcccaccatcggtggcttgaagactacgaacataagtttgagaaaatcgaccgccaactcgcccaactccagatagatggtcagaaatcatcaaacgacttcgatttccataccgcccagcctctctcccgatttttttgaatgaactgatcccaacttggttcaagataccgcatgtggagccctatgacggttccaccgacctaatcgatcacctcgagagctacaaggctctcatgacaatccaaggagcaaccgacgccttcctgtgcatcagcttctcggctacacttcggaaagctgctcgggcctagtactttgagcttcgattggaaagtatccactccttcgagcagctggaatattccttcgtggcccatttcagtaccaaccggaggccgccacgaacttcgaatagtctcttttcgatcaaacaaggagagattgaaatactctgagatttcatggcccaattcaacacgatcacgcttgaggtcagagacctcaacgaagatatggccatattgtccatgaaaagaggtctgaggggatcctgattcacatactcattgaataaaattcttcctcggacatatgctgaactcttagaacgcacgtacaaatacatgtacgcgaacgaaggagcttctaaccgacgccagatagaaaataaaggtcagaagaaaaagaacaagaagagtggggctccagctgaaacaagcaggcccccatccaataagcaagcctcaccccgacgatggagtccaaggctgacacataacaggtataatttctatacccctctctttgctcctcatgcataaatcctcatggagatcgaagggacgaaatatctatgacaccctccgtcgatgaaagtgaggaaccgtgatcgaagaaagtattaccggttccactgagaccatggccatgataccgaacaatgcatccagctcaaggatgaaatagaaaccctgatacgatatggctacctcgaaaaacataaaagggagccaccgactcaaccccctctcgattgacaaccccaaacgactgaggaagctgtgaataaccaaccaaccatgggagtcatcaacatgatcaccagacggctagactgggggggcaactttcgatgaggagtcaatgaagcgatcaagactccatgatgtaataaccttctcggaggaagatgcttggagaattcaaactctccacgatggcgctgttgttgtttcgacaacaatagcgaattatgatataaaaaggatacttattgataatagaagctcaactgacattctgttttacttgaccttcttctgaatgaaattgtcgattgatcgactcaaaaaaatctcgacaccgttagtcggcttcactggagataaggttacagtggaaggagaaatcaccctccccttaactactgggattgaaccacaacaaagcatcatcttcataagctttatggtcgtccgagtaccctcagcctacaacgtcagactccgaagacccggactaaatgcactaagagtgatagtctcgacataccacctgttggttcgattttcgaccaaaaatggcatcgaaaaaatgcacagagatcaacaactcgctcgacgctgtttcatgatctccgctcagaataataaacctgaggactctctatcgactgacaaattaggccaaagggagaatcaggaaaggggtgaacaagccaaacaattgacttccatcccgctaacagaaaatcctgagcaaacgatccgaattggatcataattgtccgactcgaagtgacaataactaatcaaattgctcaaaaccattgccgacatctttgcttggtcaaccatagacatgcccggtatttcttcgaaaataataactcatcggcttaacatcaattcaaacgtcaagccagtgagacagaaaaagcgattctttgccccgaaaagacaaaaagccatcaatggagaagtcgacaaactactcgcagtgggcttcatcagagaagccacatatccagactggctcgccaacgtagtcatagtgaaaaagactaataaaaaatgaaggatctgcatcgactatactgacctgaatcgagcctgtccgaaagacagctttccactgtcaaagatcgatcagctggtagatgcgacatcaggtcatcgactactgagcttcatggatgtctttgctggatataatcaaatccacatggtaccaaaggatgaggaatacacggctttcatgattgacaaaggcttatactgctacaaagtaatacctttcggtctgaaaaatactggagccacctatcaacgactcgtcaacaaaatcttcaaagcacagatcgaatgaaacatggaagtatacgtagatgacatgctggtgaaaggcactcagactttgaaccatattcgagatttgaaagaagctttcaacacactccgacgataccaaatgagattaaatccgaccaaatatgcgttcggagtgatctcagagaaatttttggatttcttattttgtaatgagagatcgaagccaactctgagaaaataaaagctatcatcgacgtgaagcacccaaatacgaagaaagaggtacaacaactgaatggcagatcaccgcactcaaccgatttatctctagatcgactgagaggtgtctatcattcttcaagactttgaggcaaacgaaagatttctcctgatcaaatgaatgccgacaagccttcgaagacctgaaaaagtatctgatttctccacctttgctcataaaatcaaaggtcggagaaatactatatctctacttggcgacatcgacagaggcgattagcttgatactcattctggaagatgaaaatcaaattcaccgatccatctactacaccagcaaagtactccacaacgtcgaaattcgatattcaagagcggagaaaatgatctacgctctgatcatatcggcgcaacggctccacccttacttccaggcacactccattgtggtccttatcgatcaaccattaaaagcgatcctgcaccatcttgatacatcaggatgaatggtgaagtggatggtgaagctaggcgaattcgacatacaatatcgaccacgatcatccatgaaggcacaagttctagccgacttcatcgtagaatgcacaatagctgacaataagtcggaagatgcaactacgaagaaggctacaacccccgagcccaacctaaggtcgatctgggtgctgcatattgatagggcatcgaatgctcaagatagtggagctggtctcattctcaccaactcagaaggggtagtcaccgagtatgcccttcggttcaacttcaaagcttcaaataatcaagcagaatatgaagctctcttatctagtttgaaaatggctaaggagcttgagattgacagtctgaaagtcttcactgactctaaactgatcgtgggacaagtcaaaagcaaattcgaagctcgggatccgatcatggcaacataccttcaaaaggtgaaagacctcatgatgaatttaagatacttcgagatcttccatatacccagggctgagaatgctcgaaccgatgcacttttcagactggcaatgactgcttatagttcgctaggccgaatatttgtggagtgtcttgagcaatcgagcatcgacaaaaatgaaaaagtattacagctaacagtcgaatctagttggatggatctgatcattcgatatctgtccgacagagtcctccctgaagatcttgtggaagcaaaatgaacctgatgggcagcttcccagtatgtgatgatcgatggtcgtctctacaaaaggtcattcttccttcctttattgatgtgcctaggatcgaccgatgtcgactatgcacttagagaagtacatgaaggaatttgtgaaagccacttggggggcaagtccctagcctacaaaattttgcgacaagattactattggcccaccatgaaaaaagatgcggctgacttggtccgaaggtacgaaccatgccagaagtatgccaacatacagcatcaacctgccagtcggctaacgtccattgtcgcatcctgacctttcgcttagtggtgaatcgacatactcgatccttttcctccgacgtttgaccaaaaaaaattcatagtggtcgcaatcgactattttatcaagtggatagaaatcgaatccctgtcccaaatcactgaatgcaaaatggaagacttcgtttagaaattcatcatctacagatttgaactgtcgcataccatcatcaccgacaacagacgataattcgataatcaggacttcagagaattttgtacaaagtttcatattatatataagcttacatcagtcaggcacccgcaatcaaacggagagaatgaggtgaccaatcgaataatcttgcatgggttaaagatccgactaaatgaggctaaagatctttggatcgaaaagctatatccaatcttatgggcgtattggacaactctccgtataccgactggagagtctcctttcaacttagcctacggaacagaggcgatgatctcactcgagatcgggttaccatcgacaagagttaagcaatacaatgaaccagacaactccgagtgtcagagagccgacttagatcttctacagaactccgacataaagctcaacttcgcatggcaatgtaccgacagaagatagctcggtactataacaccaaagtcaagccgaaagttttccgaccaggagacttggttttgagaaaaatagaaatttcaaaacctctagatcaaggaaagctatctccgaactgggaaggaccctacaagatatcagagacaaatagaccgggtgcctatcggctcaaaaccttggaaggtttgactattctccgaacatggaaaccgacaatctaaagttgtactatcagtgatccttgtatgcacttgaaaatacagttctgttccagaatcataaatcagacttctaatgaaatgtcagtcctcgttgtgaaggttagatcatcgaagtcatggcttggggtctgattttccaaagaagtcagaaaccttcaacctgaccatcgactgcatcccgactctcctacagaaccgacctatctacttcaatggaaggctagcgccagccatgcagatttcctccaaaaaatcatgccgcccccatagtcagcttttcatgcaaatggctggctaatttaccaacttggtatcaactaagaaagataaaataccaaaatgaccaagatcaaattggaattataccgacatggccacggtcagtcgagaaatattcggcttgccatcgtttatcagataatacgacgtataaatgtgatcaaggtccggataatagatatatgacttactatcgttatcctaactaaatacattagaaactacacgactagcagaccttacaatctccagaatgatcagatctacgatctatactcaaaaattacttcacagacggacatcacagatatttttgcaaataaaaattctatcttgaagaaaaatattttcattcagtatcagaaaagattacaaaattggatcaaagtccgattataactttctttacaaaaaataaaaagatacaccgactaagcttcgtcatcgttcctttgttcggggtaacgtcgccaacttgaatgatttcgggctcgatcggtgcttcaccctgtgtcggagtggcttcttcttcatcagcaccatcttctaatctcggagggacaatgctacccagatcgagatccggatataactttctgaccgcatcacggccgtcttcatacccgacacgatacgaagcgaagccacctttaaggatctcttccttgaactctttcgagactcgaaaatcttcaactatccgacctagtgcttcttttgccgactctacttctgcctttgccaaatcagcatcggcttgagcagataacaattcttcttcagccagtgccaacctttccagattggcccgatgacacccatattcagcttcgagttcttcaatgcacccatcttgctctcgtcaaagttggtggagagaatacctcttgctcttgacctatgcatcaagagtcgaaatagtctcgtgagccgatttaagttcggcccccgaggatgccaagtcatcggtaagtcagaaaatctcctcttgaagtttggcttcccactccgccgccgacttgagttgttcaagcgtggctgccttttcgacgtcagcggccactatcttattctcccacgcactccgaatatcgacgaactttgtgtagtcggcctccagatcggacatatcgtggatcaactacagacaaaggataagtcagttaaaaaaaaaagagaaaaagaaagaaggattttatcgaagaaacttatctcgatgattgtcggataaaaggacaaaaatatcttgaccaccgatcgcttcctccgacgcttctgatcaaccgaaagaaggatcgcctgacatagtcgcttggccaatacgaaattgaccaaagctgattcaccctcgggcactcagaggttgaagtgcatcgcatggccctttgaggtggcttcatccatcgatgccgccagagctttcccccgatcttttgtcagcggccccatgttcgagagcgaggggaagctcgagttcgactgcgccccgactgaaggagcgactggtgcagccacagattgctcgggttcttctacctcgacccgaacctcctcgaatggtgagaccattgatgttgcttcagtggtcccccttactggcccctcctcagacggtgcagcaggaagcactgtcggagccgatagtgccaagatatgattggaacccaataccgatgggacgtcaggttccatggccgatgtcgaaacatcggccggagctggtgcctgatgcctcttcgatggacgtgaaggcccgacctcagatgctgccctcttcttgacagcgtgatgatgaatgtcggcatccgacacacgtactctttgctacatagttgcaattacaatggaagtcagtgcaagttagcaaacaagaagaagatcaagaataactgaccaattgaactgtactatacctaggcaaggaactgaactatgaccggcatcataaagagcctgtttgattacaagctctctctgcttcaggaccgatatatttctcagccgatgaaagtccttctgatcgtcaacctccactcgactgttgtcattaggaccagttcgggggttgtcccaacgagaagaaaaactccaaggaagagaagaagaggcgaagaaaaattgattcttctatccatgaatagacgatggaagatcgatgatgaatgaaagatttttttgagggttgaagaaccaccaccctcgagccttcgggtgggatcggaggacgaaaaaagcccgaaaaaaagaaaggcgggggacggtcggcaacatatgacataataaagaaaaactgattatcagccagatcgaattcgatgccagctgagccggatagagtccatagtaatccaagatatttcggacaaattttggaatcgaaaatcgaagaccgtccaaagatcttcgacgtagaaggccatatgcccgatggtgggttattcactcgacgatcagcttcaggggtggaaagctgaaactgctctgggatgtaaaattactcccaaagccgttcaacattcgattccaaaagtgaagaagcctccatgtccggactcaattgagactcatcagtcagattctccgactgatcctctcgagaaggagaaacccttgccatgaaaatgactctaaagaagacaagaacttcaaggaaaaaggattcgaaagaaaagttaacctgagttggagcaacaaccttgggtgtaggggcaacgacccgacagagtttcagtaccaaggacaggaaaaagtgaagatttggctaagagtgaccctaaatataggatctatcaacgatcgagatgaaagcgatcgaatcaaagatctatcggatgacgacatgtggcaacatctgggccgaccatggatcggatggtttgacacacctaccccagattgaaccatgtcatccctatccgcgtgaacgcctctgactcaatggcgccccgatacatggcaaaaatctacatgccagaattaaatctcgcgacgtcggttcacctttttaatgtaacagctggtgtcggctcacctttttgatacgacgcctgacaccagattctcctatcgatatgacggctcgaaagcgacaaaatgactgttcgaccgtattccaacgaaagtggtgatagagccaggattcgacatgacagatagcaactccttttgtccaaggcaattaaccacgtgacgatgcacgcgatgattcaccattggactcgaaagtggggggaactattggagtaaaccgaccgacctccataaaccaaccattctgtgacacacaccgactaacatccgactccgacccaccaaacgaacagacaatcctgaaagtaattgccaactatatgtcggctgagcaggccgacgctgctctcgatcgatcaatcgaacaccccttaacagatcaagatcggtaggcggatgatattcggactctacagataataaattactttgatcgttgatatttcagagctactaaccgacaatcgactcccaacatacagttggccgactcattgaaatatatcataaccgtcgtggacagttattctactgatactgcgacataattcatagggattaataacccactacgagattatcgccttatgattctacgtcgctaaatgcgggaccatatccgacagttacgacgatctactctataaaaagggggtaaggcaacaagttttgataagctaatttttgatatgctgagctttgtctccattcccattctactattgcctaatctccttctgaattaaacattggatagtctccatcggagacaactcctgtcagtgcggattttattgtgcaggtattcattttcgatgaacagacggtgaggggattggcagcaacactcttcattattgaagactggttgggttcatttaaacacggacttgaaatttggtcaacttagtgagttaacatgtgcctgaaagtgacaatccttgaaccatcctcttttattcttggaagatgataccacctccatcatctgttcattctcaaacctcccgattgtgccctctaaatacctattcatttttttttctttttttgctctttagagcaatgcaaggagctctatttctatctacttccattacacgtatggttaaaggtatgttggcctgggtgtctaatttcctgttgatctaagaaggactggatctgaatacagttgatcctaggttattacgatcattacgtaagttaagcaatgcctttctcagtgcaacattatggcttgaagttatttgccgaaactttggatcaaaatgttctcgagagatttaaccataagctatttaagattatgtgagagatcctcggttgaggtgtgcaactcagtttctcagtatagccccaatgaacctgctaatatattgcaggcacctcctgttctcgtgtttctgtatggtgcttcccaaggccacgtagattcccagttgggctggtaatccagacttaactacactgccaaggagccagcataatgcattttctgagtttatttgatgtatttattgttaggatttgatgctttgagattcgatctatattgagcccacagtgaggtccgcgacgatgaacagtctaacgagcccaaaattacctcaaataaagtccagatgattgagatatgctcgattatatttggcacaaaatctgaagtgacagaggactggcagagcagtggtggcgtggccatgcacggcagtatgcagcctgggtgcgagtgcacggcctaacatgcgaacgcgtaggcgcatgaatgcgtgaagcatggcctagcacgcaaagcgtggtccaggcccaggcgcatgtgcgcggcctaggcccaggcatgcgggcgcaggcacggcccaggcccatgcgcacacacgcgtgggttcaacgccccggtatcccgatccatggtggaccggatggtgcataggcgagcacgtggaccacgagaacatttttctttgatttctcgcagtccaccatggaccagatgccgttttcttgatgtttcttatggtctatggattattctatggatcgatgcacgatcggatggcttagggagttgtcggccatgatccgacagttctgggaggtcttctaggtgatgtaggacactgtttcctattgttttacggctttatgcctttaaaaggtcttatttttatggctttaagcctttaaaaggctatgttccgtgaacagagagtaggtgtgcgcgactttgatcgatgaagaacctagagaatagaagcatggtgccaactggagtagaagaaggggcttcaagtaggctgttggacaacgaacagtggtcgcttcaaagattcaggaggggtcttcctagagagagtttttgtgagggagagcttcctgtgagggagagattgggtatatgagggttgaggatgtgatctcctcttataagttttctcttttctcatagtgaagtttgcatgcctcatggagatgagcctttttttggttgattcacatatttgattatttttattttatttcttttttcttcttgttgtgacgtatagtatcgaaaagatcctggaggtggtgtcctggccagacatccgccaacaaatagtatcagagtgaggcggtactaggatgcagattgcagcagtggtgagcaagattgaagttggagaagataggatcaatcaagatagagatcaacaaatttgatgaaaagagtaatttctccttgtggtaggcaagggtgaaggacatgctcatccagcaaaagttgatcgatgatctcttgtgcgaggagaagccaaccaccatggaggtataggattggagacggttacagatgcagatggtgagtaccatccgtatgtacctagcggatgaggtggtgattcatatgcttagcgaaacttctccgacggtattgtggtcgaagctcgagaagttgtacatgacgaaatctctcaccaacactttttttctttggaggcagttctaccagctgctgatgactgaggggtagagcatgcaggagcatctcaaccacttccaaaagatcctcaccgacctcctcagcattaacgagaatattgaagagaagtccagggcgctggtcttgctagcatcatttttctcttcatatgaatccttggtgactactcttctagtgaggaagagcaccatcaagatggacgaggtcactgtggcgattctctagaacgaggttctcagaagggagaacccagtttcgatctcagctgacggtagctcagctttaatggtttctaaaagagcaggaggtggtagacaggatgacagaagatcgcggtgaggacggtccaagttcaggatgagggacttgagcaagactagatattatcgatgtgatgagttggggcatctagccagagattgctctcaactcagagatcgaatgaggactactgcagtgacagccaataatgatttataggatgatctctggagatatttgactaggtatctacttctttccagcagtgaattttagattctgcatgcatctatcatgcatgttgcagagaggagtagtttgactctttggaaagtattgagggcattatttatctaccagatggatcgaactgtgcgatcagaggcatcaagacagtcagctggaagatacatgatggtgcaatgaggagattgagggaggtccgatatatacccgatttcagacagaatcttatctcactgagcagactgaattcgagagactacaggatggtagctggtggaggaatcctgaaggtgctacgctgcgataggattattctgaaggagaagaagacgagaggacattactatctggtagggagtccagtgcgaggtggaacttcgagagccaggaggagcccagagcaagatagagctccagatggaggtggatcgggcacgagatacgagatttaggaggatgagaggtaatatcgtagggtgagattcctattgctgcaggataatacctcgaacagatcttaggtcagaaggagcacagcatacgacggagatgggatcgagcggtctagctcgactcccatgtttgcccatccatgatcagcaggcaattgacctagggcatgagggcgaagagattcagaagctctcagagttaggaggaggctgaatgtcgagttgagatgaagattgttaggatttaatgcctcgagatttgatctacattgagcctgcagtgaggttcacgacaacgaacggagtccaacgagcccaagatcatctcaaatgaagtccaaatgattgagatacgctcgattatatttggcacaaaattcggagcaacggaggatcggcggcggacaggcggcgtgtaggcggagcagtggtggcatggccgcatgtggcagtgcacggcccaggcacgagcacacggcccagtgtgtagagcacgcggcccaggcgcacgtgcgctgcctaggcccaagtgcacaggcacgagcacgacccaggtccagacacacgcgcacgggcacgacccaggcccacacgcacgcgcacatgagttcagcgcccgggtatctcgatccatggtggatcgggcggtgcataggcgggcgagtggaccgtgagaacatttctcctcgatttctcacagtctcatggtccacggattattccgtggaccgatgcacgatcgggtggcttagggagctgtcggtcacgatctgacgattctaagcggtcttctgggtgctgtaggacattgtttcctattgttttacggctttaagcctttaaaaacctttgttccatgaacagagactaggtgtgcgcagctttgatcgacgaaaaacccagagaacagaagcacagtgccgactggagcagaagcagggacttcaggtagactgttggacaatggacagtagttacttcaggagttcaggagggtctccctagagagagagcttttgtgagggagtgcttcctacgaggaagagattgggtatatgagggttgagggtgtgatctcctcttataatttttctcttttcttatagtgaagtttgcatgtcctgtggagatgactcattttttggctaattcacatatttaattatttttattttatttcttttttcttcttgctacaacgtgcagtatcgaaaaaatcttgagaaatggtgttctggccaaacatccaccaacattcatgctagatgggtataatctatctgttgtatcaaaaaaaaaaaaaaatatctggacttaactagagcacatgcagttggcgtataaattgcatgcatacaattaaacatccattaaagaaacaaaaaaccattagtaacaaaggaaaactggatgaattcattgatccaaaaagaaaaaggaatattttctatagagctaagccaattacatgtcacaaaatcagccaatgaacatgaatgtctcacacaagaacaaaacagagaagagattttttcctttttttgagcaaatgatggaacatccacgccacatttgatttaaataatgaaatgaaacaaaaggagtggtagagacaagcacttgacctgcaatacaaacaaaacaagtcccctgcaaacaagaaacaaagcgacaaccagaaacagagcctcgggccctgtatgctgcaaggagcctctatatccttcctcttccacttgaacaaattagaatgacacatctgtttaacgagagttccatcaaaaaagtatctgtctgatgacagtagtagttcacactttcattttaattcaaaaagagagagagagagagagagagagagagagagagagagagaggagaataacttactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagggataacaaattcctttttgttttggtctatttccacatgtgtgctatgctaatttttgggtatcatgtcaatgttacatttaatgagaaatatttgaaccctttataatgcaaagtcagttgaggtctcactatcctcctcatcgaggctaccttcgcttgtgacctctttgagcgcttctgatttgctgacggtgcgacttataacatagaaagcaggcactgaagggcttggaagaggaacagagttaccatcgagcatgagaacgactgttgccatactgggtctcttcgctgggtctgcttgaacgcatagaagcccaacgtgcatgcacattaatacttcttgcaattcgcactgatcaactagactttggtcgatcacctgtgatgccattccttgattccattgttcccacacctgccaataattggtttaaaggagttatatgacacagctcgtgttgccaacgcaattagaggattcctctagatataatgtacactagatggttcaatgttcatagtcaagctttaggaggacgaatgcttacccagcttggaagatctattgcattccccgatccttcgaaaccactattcattcgaccggtcacgatctctaaaactaatacaccgtaactaaacacatccgacttggtagaaaagtgcccgttcctgacatattctggtgccatatagccactgccacaaaggaattacaatatgtgagctccattgttggacacttatgattgaagttaaagacaggagtccaggatacaatttttactcttgatgatttcatgatgtgtttcccatctctgcatcgaaacaaagagaaaatatataggcttgtacttactatgtaccagcaatttggcgagtgctttcatgggttccgtccatgccaaaaagctttgcaagaccgaagtctgaaattttagggttcatatctccatccagcaaaatgttacttgcttttagatctcgatgaacgatccttaggcgcgaatcttcatgaagatagagaagccctcgagcaattcttttaatgatcctgcaccgaactccccattctagctgctgtcgtctgatgggatctgttggagcaaagtacaagttagccaagttgcccaatggaaggaccaatgaggctacaccatctataaaaagattttgcagcatatccagaggtgctataaacatttatgtatcaccgaaaatcgtaaaagcgttttgaatgaagagctcttcattgaaagaaagaaaggatatctacacgagtattacaatgaactactagaaaataaggctacagagataatggtaacattgaatcattattagattaagaaacaatttgttgtagtcagatgtcttgcctgatagattgaagaaacggaaattacagactactctgaagtgtccaacaatatgaaccactgaattcaatgcaataggaacaatatcggcatcctcaagggatgacaaaatttttaaataacaggcatctataaggtggcatacagagctagtgacaaatataaacccattggttggtatttacgacagtcattctttctttctttttttttcctcctaaaactcttttgagcaaaagacattatcgtagttcttatgatagggtttgccccaaaaagaaaatttaatataaggatgcacttatataatggagcttaccgcataaaaatctgtcgagacttccgttaggaagatactcatatacaagaagcctctcttgctcttctaagcaataacccaacaactttacaaggtccctgtgctggagcttagcaaccaaaccaacctcattccgtagctgttctagtccttgccttgagattattgagagcctcttcacggccgtcacttctcgatctggcagtattccctttattgcattttaacaggacagtttaaaagttaatattttggtcgagttgaatttcgatttttgtaaattttctccaagtaaaaatgtcaatctttgagaactaatcttggggttaccttataaactagtccaaatcctccttgtccgagtttgtttgcatcagagaagttatctgttgcaactcttagggtttccaaatcaaataccagagactctgcactttcgatctcctttccatcttcatcatctgcttcttcagcatctgctctcgtttaagatacatacagtcaaatttgatgcaacgcaagtgtgaagtaaatataataattctactcaacacatacatgatggtattcctcgtagtttcctttgtcgtaagtaaatgcagatggcagagagcagcaacaccaccacagctacagttgttatagtaattacaataactattttgatggttttaccagtatttcctggatcgaaatgagagaaaaccagttaaaatcatgtttcaaagtcgaaaaaataaatgaagagccagaaagaaaacccatatgatgcatatcaacacacacctgtaatgtccaattagcctaacttaagagttgttggcgaaattggtaatttgctatatcttattttttttatttattaaaaataattctctccatgtagggataattaaggtgtatatatatattttttaatcaacgaggtacagtttggaaacaactggatcaatcctgtaggatctgtgagaaacagaacaaaccaatcaagccccgcccagattaacctaaccaccctacatgttattcatatagcttggcataccctaacaggctggaaagttgattagatccctgcttctaatcttttctttcaaagaaaaattcattgcttgatttttaaggggaaaccggagagaaagaacatggatatttaagaaagcaggggggaaaaaaaatcaaggtctatggccattcacctatttaactttcgccagaatgttccttttattttatttatttttttaaaaaccttgtttattttatttattcacctcaacttacctcgcggcggagaaacaggaggatccggcggcggttgccatgttatagccttggaagcgtcaaagaaaggagacgtctgataccgaagattacaacttaatccatatatgctggctcctgagtccccatcacagcattgaggaatatattccacaaaatcttgaaggcatcgatagcactcttgttgcggtaggtccttcgtgcactgcaccagtgcatatagcatgctcgaattcataatatttgctacgccggcggcgaacatctttgaagtattcgccgcggttgtggtaagattgtccatcatcagacctacaaacttcttgaactgttctggcggatcagaaccctggctatcaccctgaacgtaatgaaaacttgtgtcagcggtggagaagaagttttggtcggagtagcggaggaggcacccttcgtaccaaatggccgagatcttgccatttgggcaccgtttgatgatttctttggtggatatattgaggcagctcgtgcactgggcaggggataggtcgcctcggcatagggcaaggccatagacttggtgcggcggttgaccctcggtatagttggcgaagccggtggtgttggcagcggagagggaggagaggaggagattgaggttggcttggaaggtgccgttgggggtgtagttcccgtctgtcgttgggcaggcggtatgttcgcaattcaatagctggtagtcagaattggctgggggactatggagtatgaggagaagagaaaggaggacgattagtactgagaagttgggaccgtcggagcacggcatggtttcatgtgggacttctttttttttcttttttcttttttctttttttttgtttggccaagtaatccagaagagagagagagaacgggaggaatggcttcccaattatcagaacggcccgtcattggagacttttagcatgaatggaattcgtgctgcgcggacaaccggacgaaataggtgttttgcaacgcagaccacgtcatccatcatctcggtgatcgacggctctccatgtggatggcagagcggctatcctgagttttccagcccgctgcggtgtaaaacacgcatcagaggtgatagagacaagatggatgtaactatgattttttttttgttttttccagcaataaagagggggtagcatgctgctacctccggtttccgtcaaaaaaaaagacaagatggatgccatgatgggttttttctgggaagaggcgggatagggtggtaatggagacgttgtttgcaaaccttctgattagctgtggagagcaccggggtgaacaaaacagcgcagtggggaaaagggctgggccggcttccgttgtcgccttgtatcaaatattccccaacagaacaggggtcctcatggtcatatctagaaaggatagctctgctggtcgcggcggctgcggattgcacgagaatcgaagccactttcggagaaattaccagttaaaaccattccacacccgtgttgacctttttttggatgatcgaaaaatacgcggatagaacaattctaatcaagaatttttcctacgtttgctcgagaccactttgagcgcgtctgatttcctgacagtgtcactttcaacgtagaagtggacactaaaaataaaattttcttctttaaaataaagggcttggaagaggaacagaatttttttcttaaaaaatataaaatttcattgcttgacctgccatcggagcggggaagaaatcactaacgcctcgtttgagagtttgagaaaggagaaaagagactaaaaaaaagaaagaaagaaagtgttacggccaatcccgtcgtcgcctgatcaccgagaacaagtgcctgcaaaagaaagtctacgctgactggaggcagctccggcggaaaccctccgacggtcaagtcagagaagagactaggcaacagtgaaaagaagacaaggagctctacgaggagagagagagagcaagtctgagcattttttccggaggagccccctttagcactgttgccttccccgatttatagttggaggtggtatggcctcgccgtcggtgacgtagacaactggagagttgtcaaatcgccggaaattgtcatgctgttgacaaagttgacaggtcttaggaattaattctcgtccttagtaggacagcgctccaggcttcctggcagggtaatgccccctgacgttcgtgcggtgtttacttgatgggactgcagcccacgccgctcatccggcatctaggaaggcctatagaggtgagacgacagccatccaaactgatagtgagtcgtcggcgtcccatccgatgggaagtcgtcggcgtcgcaaccgatgggaagtcggtgacgggggtcggccctcaggcgatcggaggcgacgtggggccgctaggccgatccacctcggtcggggcacaatcggtagtcgctgtcggtgtcgcccgcggtcggtcgggaggagtcggtcgggtggagtcggtcgggcggagtcggtcggccggatggagtcggtcgggtggagtcggtcgggtggagtcggtcgggcggagtcggtcggtatatcccaacagttgcccccccactcctgagcctgatgtcgtgttggcccgcgtctccacgcgggtaggatgttgggcgaaaggagtggattccttgccgagtcctggaccgagtttgccgacctcaccggtggatagtccgggcaagtcgatgtcaggtgtccccttgtccgatgactcgatgtcaagtgttccattgtccgatgacgcgacgtcaaccaatctggtgtcaggcgatcgggtgtcagacgattgggtgtcagatgattgagtgccggacgatccggtgtcaggcgatcgggtgtcagacgatcgagtgccggacgatctggtgccaggcgatcgggtgtcagacgattgagtgccggacgatccggtgtcaggcgatcgggtatccggcgccttttggggaacgcaaaccgccatccggcgccggttctgagagcacgggtcgctgtcaggcatcccatcggggacgtgaatcaccgcgggcaatttaattccgaatcgcggcccttccgtcatgtgtcaggggttgttggcccgacgtccctcgcatttaatgaagacggcgtggcctttccgggatgggtgcatcgaaccgtcggatcgaaaggggggtccggatgccgccacgcgtcgctcattcgagaagtcttggtcggcgcggcatcatctcgaccgtcgaacagccctatatatatggggccacttgtactcgaagctccatttctgacggttttgctgcagagactctgcccaagcggtctctctgtcgtcgacggcagccacgcccacccccactcccgcaagggttcgttcggagctcgccccctcttctgttttgctctagttttctttaaaaccttttcttttccttctccttcttcttcggtcttgtcttccccttggttctggtgttatagccagaacctcacctcaggaggctcggtcggaaaacccgaccgatgaccttcggtcgactccggaagttgaggtttcctcactttcggagccgaatgtggatcggcttcgggatcagtatcatatcctggagcagttccaactttccgccccaggggccggcggtcgggttaacaacccgcccgcgggccaagtggcactgtacgtcgaggacctccgggctggtcttcgacttctgatttcggagttcgtccggaacctgctagattattacgaactctgtccggcgcaactggcgtcgaactcggttcggctgataatcagcttcgccctcttgtgtcagctcctactgaccaaccctcggatttctctttttcgggtattttttgtcctccgaccccaccttaaggcccgagggtggtggctcttcaacccccggaagggtctttccttcatcactggccttccatcctccattcacgggtagaagaaccagtttttctttgcttcctcttcttctccttggggcttcccttctcactggggcgtgcctagaatcgaggcaaacgagaacagccgagtggaggtggacgaccgggaggacttccaccgacaaagacatgtcggtcccgaagcagagggagcttgttaccgaacaagccctctatgatgctggcatgagcctggtctcccgtttaggtatcgcccgatccatcggttgtctttttatttggcattcgttctcgtgcatatactgattcttttgttggcatcgcagggacgccgccgaggatgaggccgactgatgctgaaattagacaatatgcggcgaggaagaggccggcgtcgggggccggaccttcacggccgccgaagaaatcctccacagcggcgccgaccatcgcagcatcggcgaccgatcaatcggagccggtgattgcactctcggcttcgacggtgcaatcgaaggagcggccggcggaggtagcggctgaaggaacgtcggcggcttcatcgacgggagtagcgtcggatgccgttcgggaacctgaacgttatccgtcggcgtctgcagcggcaacggggggtgctgcgtcaagctcgagcatcccctccttacccgatccactggctggggcggccaatcgggagaaagccccgatggaccccgctgacgacacaaggtcggggagtcgctccgcgccacctggcgctcaggtccccgaaggagcgtcggcgctggccgaccacaacttggccaggagactgtgccaggggatccttctcccagccgacgtggaggtgctgaaatctcggcaagtgaccgagatgctatcttcgttctacccgaccatggtcggggtaagtttcacttcatctccttccttcttagtgttttcattacttcgctttcctaacgtagcgcccacgtttgcagctaatctataccatgtccaaacttgaggtcgggtaccggaggtttgggaacgtccgggcggtctggaaggatagggcggcgaccgtcgaagctgacagggcgatgctggtcgaacacctgaagcagtcgaccgactgggaggcgaagctggtggacgaggtctctcgtctcgggtccgagctcaagtcggcccgaaaggaggccaagcgcaagggtcggactgcgcatcgtctgcggtgcgaatgggacggcgtcgctgccgagctcgaggccgaacgcgagcagctccaggtcagcctggagaatctcgccaaggctgaggaggacttgtcgattgcccaggccgatgccgacatagcgaaggcagaggtggagtcggcgaaggactctctcgatcgggtggaagcggaagcgaggtcggcgaaggagtcagtgagtcgggcggtggatgacttccgtggctccgacaggtatcgagaggagctgctggagtccgactttgcgtcgtaccgggtggggtacgaagatggtcgggatgcagtccaagctctgtacccgaagctggacctcagtggtatcattccatcgggggtcgaggaccaagccacagaagagatggccgacccgtcgtcggggggcgtcgttgtggtgggagaggccatcccagaatggattgccgaaggaaagacggccctgactcctgaccagtctccgacccatgatccagcaccgaccgtcgttccagcaccgaccgacgatcctgccacgaccgtcgacccagtgccgatcatggtggatacaccggtcatccctgagcttccatcagttgaagatattgactccgaaggatgatcgcggccttatcttcctgtgttgtttttgtttttctttgcgcacttgtaaccgggcttcgacccgattttgtagtcaaatgaacttaagaaatttctgttttccttttcgatttccttttcttgcctgtcgggatgtacttgtaatcgtgggatcataaggtcggagagccgcagtcttggcgtgccgcattaggacacccaacgtcatcccgagtcgttagtcgagatagtcggtggtgcggtatagggtaagcaagacgaaccccgaccactgatcgctcgtcttaagacctggactgaacgtccgaatgccagagtcgaacgtacgtcatcctggcatgagtcgggggtcgaccgacttccaggcacgagtccgctgagtcggccgtgccggcggagtcgaaggttgttcgtggggaagaaagtcgaccgactttcgggtgtaccccgatgaccctaatgtcgtccgatgcgatcgatcggactgcgtctggtacattatcgtacatagtcgacatgtctggtcgggaaagcgatggcaagtcgagttctccttacccagacttaggtcgggcacttgtgtagcaccgtgtgataaacggtggtaagtcgaatacccttcgaccggcctcgatccggtcggtaagtcgcaacgcggcgttggttgcattggcgcttttgcctttcccgaccggagcggggtcggcgagtcggccgatcgttctgctcgaacgttctagccgaatgttttagatgtagaaggagtgtaactcccatttttgcaggtgcgtcggtcctttaagcatttgacgcatcgttggtggtcagtccgacgacccgcagtagaacgttaagtccgtattgggatgtcggaggctcgcattccttggtgagcgtcgaaccacagtcgaagggtcgaaattccagactccgaagtttaaactgagttcacattccaaatgggggaggtacagagttcactgatagtacaacctcagattgtcggcgttccaggtccggggaatgggttttccttctagggtttccagtcggtaagctctcggtccgttggtgtcggctaccttgtagggtccctcccagttcggggataattttttctgatccaagggttttgagacctccgcctttctcaagaccaggtctccaggtcggaagagcttcggctttaccttggcgttgtaatatcgagctaccttttgtcggtaagaagccatacgaagttgtgcttcgcgtcggagctcgggtaagaggtccaagtcggctctccgacactcagagttgtccggctcacgatactgctcgaccctggttgatggcaacccaatctctagtgggattatggcttccgttccataggccaagccgaatggtgattctccggtcgggacacggggtgtcgtccggtacgcccataggacggagttcagctcttcgatccagaggcccttggcttcatttagtcgggttttgagctcgtgcagtatggtccggttggtcaccttgacctcaccgttggactgtggatgctcgaccgaggttagtcggtgcatgatttgaaatcttgcgcagaagtctctgaagtcctggttgtcaaactgtcgcccattgtcggtaatgatggtgtttggtagttcgaaccgaaaaatgatagacttctgtatgaagtcttccatctttcgctcagtgatttgtgctaagggttcagcttccacccatttagtaaagtagtcaatcgcgacgacgatgaatttctgttgaccggatgccagagaaaaatatccgagtatgtcgattccccactgggcgaagggccacggggcgatgannnnnnnnnnnnnnnnnnnnaaatatatttaaaatattaatttattattaataataatttgaataataataaaaatatagtaatatctaaaaaatagaataataatatttgaaaaattatttttttgcatccaattctacgcaatgtgtggatctacgattagttatttattaagaagaaatgtgaggattgcatgtatgatataatacacgtaacatggtaggaaatttagccctatcaatgaggtctagataaatcaacagaaaaaaaatttggtcgacatgctattagctggatcccatataattatacgctcaattttttgaatacaaagagcaagggtccatccaaatatagtccaaataacattaggttgccaatcaatctatatattgctcgacctcactcccaacggagaagaatggtccttcatttattacatcgtaatggataacaaaacaagttccaagctgccatctctgcgaagttcccacagacttccaatatcatgccaccctttagacgatatcgagaacagaccatatctgttatacaacccagtagacagagaaattgatatccgtatcattcacaaaaattattaacatcaactaacgttcaaagatgcacttatatctatcaatcacacaccaccatctctgttccacgtcggtgattgaggcttcattcaccgagactggccttgatttttctgtcctccttgattttcttgttgtgcttccattgaagcttcacttcctggtaaactagtcctcacgtccctctcgagcacctctgtctcactaattatatcactccttacaaaggaggcaggtgctgatggagctggaagagggacagagtaactcctaagcgtgagaacgactgttgctatcctgggtctctctgctgggtcttcctggacgcagagtagcccgatgtgaatgcacctcagtacttcttgcagctcataccgatcacctagactcaggtcaatcacctgtgatgcctttccttcattccagtgttgccagacctattcaaagattaggtttagaggagttatcactacagtttatgttgggtaatgtgataataggattttgataaatgttatagatactggaagcagtagatcaacctatacatttctttgtggattttgtgtatatgtgtgttgtggggggtgttagaatctatattgtgcattaatagaaatttaatacttgttagcatctatatattattttcatgttttctacattaaattgctaacatatcatcttttaaattcaaatataaactatttatttaaaggtaattagagtttgtaactcatgcaaatggtcatatctaattcaaatataaattattgatttgaaactgatgttatctgtatattattttcatttttccaatgcttacatagctaagaaggtctgaataatgcccagatccccggaatccacaattcctccggccagtcacgatctccaaaactagtacgccataactgaaaacatctgatttggtagagaagagccccagcgaggcatattctggtgccatatacccactaccataaagaaattgagaagatattagatttttctccaggaggacatacgaatgattcaagtcagatattagaacagtagtagattggacatctttccaccgattattcagaaaaggaaattaagaaggtatgcacttactatgtcccagcaattccactagtgtttccttgggtctcatctatgctgaaaagctttgcgagaccaaagtctgcaattttagggttcatgtcccgatccagcaagatattacttgctttcagatcccgatgaatgatccttaatcgagaatcttcatgtagatagagaaggccgcggccaatcccttcaataatcttgtatcgcttttcccattctagttgttgttgtccgatggggtctatttcatccaagtaaacttaatcaattaaactgataccataatgaataacaagaacagttgggccatgtgatcaacaagatgttagcaacactaaatacttatatcacaggcggcctaacctctcctaaatcgaaagaataagaagcggttatatcataaacatttaccaaaacatagcatggaaaatagttaaaacccagtagcatgcaaaaatgatgccatcgttgatagagtcatcttaataaatggatgcagtgtaagaaatcaggccctgcaaaatgatggcattcgcatctaaccatattgcaagaaacttagtacgcaaagtcagataacatctgaattagaaaatccagagtaccaaagtatgttcaaggtaatgcaaagttaaattagactgaataaagactataaagtaacataaaaagaggaataacatgtatcaagtgctgtaacagtagtgaattacgactaatcacaacagggttatgcaagttacaaacctgatgatgttcctatttgcttacaaccagggaaatactatggcaatgatcatgaaaaatatgaatgtagaaaatggagcataccgaataaaaatttgtcaaggcttgtattcggaaggtactcatagacaagtaacctttcttcttcctcaaggcaacaacccagcaacttaacaaggtttctatgttgaagcttggcaaccaaatcaacctcatttcttagctccactagtccttgtcgtgaacttcctgagagccttttcacagctatttcttgtccatcccgtagagtcccctgtatgacatttagaagatgcaggcaagcaattaccattagtcaagtcgataacaatgttcgcaactctatgatcgaccttgaggacctcagtctagataattaccacgtaaaccggtccgaacccaccttctcccagcttatttgcatcggagaagttatttgtggcagctctaaggacgctcaaatcgtataataatggtttggaacctctgaattcctcacctccatcaactactcgtaaaacaagcttaaccacataaaaacccagcccatttttctagaattgaatttcttagaacaatgatgcagcaagaaagacttacagagaactcctctaaatactttctttctacgtaaggagatacagatggtgaaaaggaccaccaatgaaacaacgacacagatggaaacaattagaattatttttgtagtattattcttttttcctgcattaaaaaaaaatttagcaatgagacaatcatttaggaatagtattcaaagaagatcatcaaactcgatatgaaccattttgatcattacaaatagagctgcacataattgaagtgagatttatcacattggaaagccaaattgtggaccaactttctgaaagtcataatttgatcatacaatatctgattgatgtgatcttttttttttaaaaaaaatcgaatgacttttttagatatgtgatgtggtgcctccctctaagagaagctgtgctcccagtgattggtccaaatttcattatttagatattgaaatgaaccaatcaaactggaagtttcttttgattagacatatctttcaatttgagaagcattaggtagagcaacagaagacaaagttgatgtatgagttgaaatctatctcacataaaattttagttgttcgtgtttgcttctattagttatgcttatttttcgagttctattctaattaggaaagaaatccaatctaaattgtataagggtggacctcaacactactattataatagaaataatgtacttcaattttcattcatcaattattcattaatgaaaaaatgacatctatattttcttaaatttttagagatatttgagttgcatagtttgagaaaattatttcttttctccaatcggatcaaacgaagatgtaactaagaccaaattaaactgcaaactgctgccatacatgccaaggaccaaaacttaaattcctcctaagaaatcaaaactagcaagaaataagtttgtttttgaagtttataaactaaggtgggctcttaaaaccgtgaagagaagtttcacagcatcacttcgacgtaccaccatgcaggagagttgtccgggattagcacatctgacagtaatatacagaggtgaaccatggacttggcatgtgcttccaaatgctgttacatatgatgcagaatgtgtttctctcggacctaatatttaaactttaaatattgattattaaaactaaatttacttgcatgccccagaaataaaagttcctttcattagaaaaaaaaaaagttctaaatactgttcaactgcggaaaaaaatgatagtcttgcgattatctctatctaactgtggaattcatcatctcaagttgattgaaagcacacacagttctaaagattaacttagcagaagacttaaattattacatggaactcatgacaaaggagggattgaagaactgaagattcaattcgttgtcaaagccagcctttttttttttttgaagggtaaccagccaaattatcttttgctgcttaatccctatcggaattactggcattctacatcaagaggagaactttgcttaccatcactggtcttgctattgccactgtccggcgaagaactcggtgccggcggcggcggagggacgaacaacatggagaagaagggataggtctcaaacctcacgtcacaactcgccatcatgacccgtcccccgacactcccaccgcaacacgaacgcaaatcctcgatcgcctgatcaagacatgtggagcaatccgtctgcgatagatcacgggtacactgtgtcaacccgtatatatacccataactggaggaattcgtgatcccatccgcaaacttcaattccgtagccgccgcctgcgacgcgatcttgtccatcagattcctcatacgcccatagaatcccgttggtgctttattgggattggcagttgacgcgttcccatccttatcgagctggccgaagaagcgtcggtcggagtagcggaggacgcagtcatcgaagcggatggtggcggacttacgaaagggacagccggcggcggcggtggcggcggagcggttgaggcaggtggaacattcggaggcggagacgacgggtaggcactgggcaaggccgtaggcgggggctgaggagtcggcgccggcggtggtgttggagaagtagcctgcgtcgcgtggggtggaggaggtgaggttggagaggaggagatcgaggttggaggagaaggtgctggggacggtgtagttggcgtcaccggcgcaggaggtgaggttgagatcatactttgaatcatactgggaataagttttggttggagctagaagcagagtatggaggattagcagagggaatagagacaagatggatgccatgaactgggaagagaagggaaagagtgggagtgaagacgacgtcgtggatggagtgcacggagaagaagaaaaccgcggattcacaggagtggtggcggttgcgggtttgagcattcgcttgagaccactttgagcgcacctgatttgctgacagtcccacatttcaacatagaaagtaggaagtaggaactgaagggcttgggagaggaacagggtaaaaaaggaaaaaaaatcattgcttgactcggctgagcctgacttcgtctttggtttggtctttgccaaaacattggtagtggaggcgttgagaggaagaaagaaaaaaaggatgatggtgacgaaacattttccatttattgacggattccaaatttgcagggaaggcgaattggaggaggttaagaggaaagcagtgaccggggcggggacgaaaccaaacgagccctaaaagggctcttcttgccgcatgcttggggcgtttcctgatggatcaagtttttttttttctctctcttttttgttgtattaaacggtggcctacgttcaagttcattaaatttattatgtggatatattggttccaatcgcagtcgtagttttaaaatgaaaataaatattttaaacggaagcctattcttgagtcgtgataggaccatttactggtggcctacatagaccacaaatgatgcaaacaagaccccattatgtggagtatacgaagacaacaaataatgttcaagtgtattaaggttccgattacggtcatagttttaaaataaaaataaataatttaaatggaggcctcttactgccctatgctagggtggcctacattgatcgatcgcaaatgatatgaaaaagaccctgttgtctggagtacactcagaaaacaaataattttcaaattctttaaatttattgcattggtagactggcttgaatcactgtaatggcccagttacttgggcctgtagcccagacggcccatcaacaaaaaaaaaaaaaactagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgtgtggccgtgtcatgtgtccaactcagatgctgggtttggggcgtgacaatcaccatcaaaacttttaaataaaaataaataactctaaactgaggactcttggtgccttatgctaggggctgtttaccggtggtctatattgatggcaagtgatgtaacaaaaaaaggaaaaataactgtgtggattatattgagacaataaataatgtttaagtttattaaatttattacattgatatattggttttaatcaaagtcatatgtttttaaataaaaaataaaaaattctaaatgaaagactcttgttgccttgtgctagggtttgtttactgctggcttatattgaccataaatgatataaaaaaagatccagttatgtggattatactaaatcaacaaataatattcaagtttattaaatttattatattgatatgttagtttcaatcacaatcatgatttttaaataaaaataaataattcctaacagaagacccgttttgccttatgctaggggtctggtggcttttattgacggcaaatgatgtaaagaaaaacacaaattgtatggattatactaagacaacaactaatgttcaaatttattaaatttattatattgatatattggttttaatcaaactcatattttttaataaaaataaataattctaaacgaaaggctcttcttgtcttatgctaggaatgtttatttgtagcttatattgaccgtaaatgacatgaacaaaacaccaattgtgttgattatactaatcaacaaataatattcaagttctttaaatttattatattgatatattggtttcaatcataatcataatttttaaataaaaataaataattccaaatggaagactcgtcttgtcttatgcttggggccgtttactggtggcctttgtttgatggcaaataatgaaaaaaaacatcaactgcatggattatactaggtgcctataatataagcagctagaagttttcccaatatagcatttgtttaggagagatgtgcggatcacatatatgatagagtgcacataacatagttggaagtttaggcccgtcaatgtggtctagacaaatcaacaaaaaagcatggtctatatgctattagctggatcccatggatttatacgcaatttttcaaacataatgaatacgtgcttcatccaaatatagtcccgataacattaagttgcccatcaaactaatataatgcttgtgagatattacttccaatgtagaaggatggtgcctcatttattccatcacagtcggtaacaaattcagttccaagctgccatcaatttaaagttcccacagacttccaatatcataccatcccctggatgatatccagaacataccatatctatcatacaacagaggtgacagagaaattggtgtccctattgttcacaaagattattaacatcaagtaattttaaaagatgaacttctattgataaatctcacacctctatcgcggttctatgtcagtgattgagacatcattcaccgagaccggcgttgattttcctatcattgttgattttcttgttgttcttccactggagctctcaattcctgataaaccagtccacacatccccctcgagcacctctgccccaccgactgcatcgcttcttataaagaaggcaggtgctgatggagctggaagagggacagtgtaactactgagcatgagaatgactgttgccatgctgggtcgctctgtggggtctttttggatgcagagtagccctatgtgaatgcacctcagtacttctcgtatttcatactgatcacccagactctggtcgatcacctgcgatgccattccttcattccagtgttgccatacctatgcaaaaaaaaaaaaagtttgtttaaaggaattaccgatacagtttttgttggctagtatgataatgggattagaatagatgccgcggatactggaaattaatgctagattaatctatgtttgggggcacgggcacgggtgttaaacgcttacataactaagaaggtctggagaactcccagatccatggaatctactagtcctctgcccagtcacaatctccaaaactagaacgccataactataaacatctgatttggtggagaagagcccatgcaaagcatattctggtgccatatacccactatggcaaagaaattgagaagatattagatttttcaccatgaggacatacttacgattgaagttagacattctctggaaaggaaattaaaaaagtatgcacttacaatgtcccagcaatttgactagcatttccttgggtctcatctatgacgaagagctttgcaagaccaaagtctgaaattttagggttcatgtccccatccagcaagatattacctgcttttagatcccgatgaatgatccttaatcgagaatcttcatgaagatagagaagcccacggccaatcccttcgataatcttgtaccgccttccccaatctaattgctctcgtccaatagggtctatttcatccaagtaaacatgacaaatttaactgatatcataatgaataacaagtacatttaggctatgggatcagcatgatgttagaaacattaagcagttatatcacaagtggcctagcctcccttaaatcaccaaaaaagcagttatatcataaatatttagccaaaaatagaatggacgacggttaaaacccagtagcatgcaaaaatgatgccatcaatcatagagtcatcatcttaataaatggatgcggtataagaaatcaggttatgcaaagtgatggtattgatatctaaccatgcatatatacaaagctagataacagctgaaacagaaatccagagtacagatatatgttcaaggcaatgcacagctaaattggattgaataaagagtactggtaatgacagagcaataacatgtaccaagtgttgtatcaaaaatgatgatgttcctctttgcttaaaaccaaggatgcaccatggcaatgcttaggataaatatgaatgtagaaaatgaagagtaccgaataaaaatttgtcaaggcttgtatttgaaaggtactcatagacaagtaacctctcttcttcctcgaggcaacaacccaacaacttaacaagatttctatgttgaagattggcaaccaaaacaacctcatttcttagttctaccagtccttgccgtgaagttccggagagccttttcacagctatttcttgtccatcctgtaaagtcccctgtatgagatttaaaagacacaagagagcaattacaatttgtcaaatcaataacaacattcacagttctgtgggtgaccttgaagacctcagtctggataattaccttgtaaactggtccaaacccaccttctccaagcttatgctcatttgagaaattatttgtggcagcactaagggtacccaaatcaaataataataattctgaatttttgaactcctcatctccatcaactactcacaaaacaagctcaactatataaaaaaccagcccatttgtcttgaattggatttcttataacaacaatgcagcaggaaaagaaaaacttaccgagtagtcttctaagcattatccttcttcgtaagcagatacacatggcgaaaaggaccaccagtgcggcaacgacagagaagacaacaattaaaactactttagtagtgttattacttttccctgcaccaaaagaaaatttagtttttagacacgtcatgtaggaacggagatgtaaccaagaccaaactaaactggaagtctgaaaattgcctaccatacacactaaagagcaaaaacttaaattgcttattatttggacacaacctattttccttctaagaaatcaaaactagcaacaaataagttggcttttggagtttataaaataaggtggactcttgcaaactggaagtgaagttttatgccataactctacaaagtgcaccatattgaggtgaatcatgaacggaaatagcatttattgtgctgcatgtttgcaaaagctgtggtacatacgacgcagaatgtgtcctccggacctaagctttaaacttttaaaaaaatattttttttttaaaaaaaaggattacagcagcataagccgccgacatgctatgtggtctgaaggaacaaaaacacagtcattattaaaactagatttattggtatgccccaggaacaaaagttcctttcatcaaaaaaaataaaaataaaaaaaagaaaggaaacaaaagtatacggttcaactggagaaaaaaaatcgtagattcttgcgattacctctatctaacaaattaaggaactcatcatctgattgaaagcacacatacttctaaagattaactgaggggaagactaaacttactacatacaattcatgacaaaggagtagaataaccgatgatgtaatttttgttaaagccagcctgttaaatttatcttatcggaggtactagtcgtatcgtccaaatcaacaactcagcgttctgtttaactaaatcattcctgagggatcgaggcattctacatcaaggggagaactctgcttaccgtaaccggtcgtgttagtgccattgccactgtccggcgaggtactcgatcccggcggcggtggcggcggagggataaacgacatggagaagaagggataggtctcaaacctcacggcacaactcaccttcaaggcctgtccccccggatgcccatagcagcagataggcagaaaaccgaccaccttagagagacacgtggagcaatccgtctccgatagatcacgggtgcactgtgccatcgcgtatatattcccgtactgggtggaatttgccatccccaccccaaacttcgattccgtcgccgccgcctgcgacgcgctcttgtccatcggacccgtcatctcccgatagaacaccgctggatccgacacgttagtgggattgacaacctgccaggtcgtatcgtcttcgagctggccgaagaagcgttgatcggagtaacggaggatgcagagatcgaggcggatggcggcggacttgcgaaaggggcagacggtggcggcgaaggaggcggagtggttgaggcaggcggaacaggcggaggcggggacatcaggtcggcactgggcaaggccgtaggcgggggctgaggaggaggcgccgacggtggtgttggagaagtagccggcatcgcggggggaggacgtgagtttggagaggaggaggtcgagattggaggagaaggtgctggggacggtgtagttggtgtcgccggcgcagtagtcaacgagggggccacgctgggaataagttttggtcggagctagaagcagagtatggaggattagaagagggaatagagacaagatggatgccatgatgggggtattctgggaagaggagggatagagtgggaatggggactttgcctgcaaactttctgctacgggacgcgggtagagagcacggagcaggaagaacagcaccgatttaacgggagcattgacggtgacttttgacaacattttgactttttggtttttttattaaaaaatattctggtatgagatttagggattattttacttggtcatcataaacaggttcatttggtgggcggccaagccgacggtcgtggtagaactctgtgcggcgaggacgagcaccgagtctttgtttgcgttttctattttcctgtttgcctggaaaagaataaacggctgttgaattgtgtcacgccccaaaccgaacgtctaagttgggcatataaatcgagaatgtgaattgtacagtgctgctataggaatttcaaataatattaaaagaaaaaattaatcataacaatctaactacgtaaaactaccatcatcgcgtagcaaaattattcaattacataaatttaaatattcattacacacctgaaaataaactagctaaacaatgaacctgttgcgatctcctcgtccaacggcgttgagactgcatcttctgacttggagaaagaaaatatatatatagagatatatgagctatataattcagtaaaattttattctcactcacattatcataataatataaatttttaaaaaataaattattatcaaaataaacataaataccataaaatcagaatgtatcaataatttattctaaataaaaagtatgcatatgtacaatcaaatgtcaataataaacatccacttaaaagttatatataatataatattgagtaagtcttcaataatgccagccatgttttcggctcacgattggatgatcgataggtattatgttttccatccattacagagtaattaatgttgatgcaaatttttatctcgagatcggatcaattagagttggacagcgacggtaggtcggcaatagctagataccgacggcaggacctacaaaaaaagtttctaattgaagatggctccgacagaaatcctccgacgctcaaatcagaaatccgacaataaaaagaaaggagtgagcgtatagggagaaagaaaattcatattttgagtccccgataagtctttatttatagatggaggctgaagaaccgtgagagaaaaatgaatcaggcagttagtcttgacttatctgaaaaaatatggccattattcttctcttatctggagaaacttgtttattttttattccctattcgtttttctatgatcatgagatttgaagttttatgtaaggttggatcttccagtggccgatgtcaattttttaggtggctttttgaagttagaagagggataaagagatcatcaaagatctttttgtcttcattgaatatcctcgaagatcatgcctgaccttctgacttttttaagttggatgagtaatatcacctcatggtatatgaggaccgtacccattaatagtatgtgttgacaaccagagatttgagaatggacggcttttcttttactcctggctattttcatattttaataagatgatgtgatggaacatgagataccttcatatgccttgttaggtcggtagacgagtgcaagtcgaattttggagagaagatcggtaatcgagctcataccagatctcaggccgagcctgaggtacctttatgtccttgtatgtatgagtcttcaattagtacgaaattacccccaatactaaccccctactctcgaatccaagtcataattggatcagatgaaggaaatatttctgatttgctgaagacatgccaagattatcttattagccgagatgacttgtttgcagctcctagtaagatgaagagtcacatcatcctagtgttttgtagccttttagttcatcaggatttactcgtcttaggatgagcggcatggttcaatctcttcctctgctttggtgggtgggcaactccgatgagtgggaagctttgacgttactcaaaggaggccaggcatgcgtaaggaagtgcggccactcatgggagaccgacttcagcttggtctgcttcagtgctgctcgagagcatgggaggcatgcatgggcgcatgagaaaacttggtgacgctgtaggctgcttcacaccattataggggagcgtgggtgcgggagcaggtcggggccgccaagggtggcctcgatgccaacagatgcgagcaggtacgtatagtggagagctctagaccaccatggctgtccttcctctagctagcatcaatctgttgatgcagattttcatcttgaggtcaaatcagttggagttagacggtgatggtagatcagcaaccatcggacggcggtggtaggatctataagaaaagtttctaatcgaagatggctccaatgaaaatcctccgatactcaagtaaaaaatctgacaatagaagaaaagaagtgagcgtgttaggagagaggagattgtgtacctggagagtccctcatggccctctatttatgggcggaggctgaagagctctgagaggaaggaggatcaggtagttatccttgcttagttggacgagatatgtccgttatcctcctcttatctagagaaatttatttgttatttatttcttattcacttttcttttgctctctttcaatatccttaaagatcgtgtctgaccttctgacctccttaaattgggtgagcggtgtcacctcatggctgaaggattgggttggttcactagatcgattcggatcagaggcagtagaattttaaaattttttatccaatctggcacacgatgtatagatctaaatcagatttattaaccatttatatttgcatataagagagaagagaaatgtgataatgtttatcaccttgtgcgggtagaagaacaccgtaatccgatgatcagtagatctgaggttcactgataagctgcatacttgtctgacctccacagatatccattcggatctggtctaggatgctttcttcttcttcaatccatctactcctagatggatctacaagctccttaatcagattcaaatctgatcttcaatagggctctgattgatgcttgatcacagccttctcgctccttgcacagatctgagggttttcgacacttcgaatccaccagatggtgtgttcaacacacttgaatatgaaagagcttcagatatcagagagtggagagggagttggcatggagagaatgggagaaggcaatgaaattttttatctcataaaaaaaatattcctatgatggacaacgccctatatatcttttcatctgatcgaattagatttttaaaacaggacttttctattaccgccccatctgattttctcccatattttatcgcacaaaactaatgagaaaagtcagatggcttgaagaaaggatagggtggttatcatcctattcaatctcctctgtttcgaattcaaacaattcaaattttcaatcaatcttgaattcaaatgagatcatatctcttatcctcatctaccaatggataaggcttatcccactccctctcccttatctgaatttaggtgatacacatggatcaaatccatgtggttgcacgtcccttccattggcgagaaaaattggatggcaccaacacttgacgccctcacaaatctaatctgattaggttatgaattgaacttgggctaaccaacctttggagcccaattcaagcttgcttctatttggttaaatcctatctaatagggaacccaaattaagtagaaaaaaatgggtttaaccatgtgctagcatcgtttccttaaactcaaagctaggacttaattaatcctaacccaattagactacacttagtccaattgtgcaatctaagatcaaaatccatgtttatgtgacctcatagatccaattctatctggtagtgagatatattgtgatctctatcagcaatattatggaaactctttttgatggagtggaacttctttcaattcgtcaattagaattcttgatcatcgaaataattctaattgatcctacaatccatcaattacacctagcagtatgtgatggcaatccagcagaactgaagaataaacctttaggtacaataatcgtataatttgattcttctatcataagtcccgataggatcgagatcaagattaactcatcaaaccttatccctgtcatataatagaatcaattgattcgagtccgatgtaaaattcaatagaaatacctttctatctttcacagtgccatggccatgggctttaggactcaatctcatgatttttataggactacttctctatcaagatcaatagatctcatcttggtctaacccaatgcctacaatgaacatactgtaacgaacatacacctcaagattctgtatgactagaatatcgaattatggtgtagtcaaactacatcaccctcaaggtgaatggtcgatgcacctcaggtcagagaactaaatacacagctgcagttatgaacatgtcactgacgagaaggttgatatccttgtgattgttcgtgattgatcacgctcagtatctttattcttaacaagtacctatactttcactttgatattttcataccgtagattcaagactcatctatccaaaaaaaatgatcatataccaatctttcagatcgattactatctccgtgatgatcctacgatcaaaagtaatttatgagttaactaaaattagcacatatttcaaattcttaactcttgagaatatgtgtaatcatacctattaacttaatggatgattcatagatacaattaaacacaatgtgaatgaaagtaattaaattttattaatatcaaagttaaatttataaattatgtcctaagaatgtattacaagtgtcggccaatgtggcttctaggacatacttcaacaaactctcagttgtactaaagtcaattggctacaaatctaagtttcatttttttaaggtggactttagtcttttgctggcttaattgtttggttagtggatcagccatattgtccgtaatgtcgactctcttcacttcgacatatcctttctcgaggtaatcacggatgaagtggaatcatcgcttgatatgcttgaattttttgtgagacctcggctccttagttaggactatggtgtcgttgttatcacagtagagagtaggatggtatctgatggcattatacttagttccacaacaaacttcttgaatctaaatgtcttctttgcagctttcgatgcggcgatatattctgcttccatagtggagtctgcaatcacagtctgcttgaaactcttccagctgatagtaccactattacataagaaaatactttttgatattaattttcattcatcagtatcagacatgaagtctgaatcagtatatccgtgcactttatgttctccattctcaaagatcaaaaatatatctttagtccttctcaagtacttaaggattaatttcacaaaaatttagcactcttcatttggattcgactgatatctacttgtgacactcacagcatggacgatatcaggtcacgtataaagcatgacgtgcatgatgctccctacggctgaagcataagggattttactcatgcgttcaatcttttccgaagtgttggaatatattttcttagagagattaataccatgtctaaaagataccagacccctcttggagttctctatgcaaacctcttcagcacctcctcaatgtatatcttctgtgataatcttagcatactcctagatctatctttatagaccttaatccccaaaatgaaggatgcctcttctagatctttcatgaaaaatttctcagacaatctaattttgatcgtgattaataagaaaatattattttcaatcagaaggatattatccacatacaatacgaggaacgtgacagcaatcccactaacttttatgaagatataattttttctcattcttgatgaaatcaaatgatttaattacatcattgaaatgagcattccaactccgagatgcttgcttgagttcataaatggatctttgtaatttacaaactctatgatcactattattggaagtaaaactaagtggctatttcatatagatatcttcctcaagataactatttaagaatatcgttttcacatccatttgctatatttcgtaattgaaatatactgcaatggcaagcagtatgcggatggacttaagaatggctacagatgagaaggtatcttgatagtcaatttcttcgcgctgaccatatcttttcaccacaagtcaagctttaaaggtctttacctttctatctgcacctatctttctcttgaagatccatttacacccaatagataaaataccttcagatggatctatcaaggttcacacttggttagagtgcatcgagttaatttctgacttcattatctctaaccatttctcggagtcgatatcagatatcgcctcgctatagattttgggatcatctccatatatcacattttctgtgagaaatattttttctacatcctttgagataatacctaggtacctctcaggagaataaaaaatcctactagacttacgaggtgaaggaggaagtgtgtggatcaactcagactgaatggattcctcaaattccaaggctcgctactcttcagagactttctcctcaaacctaatctttcttcctatgcctccatcttgaataattatttttcaaaaaagactatgttgattcacaatcacattatgattttctagaagatagaaataatgtcctaatgactccttaggatatccactgaaataagctctaagggatctggtttctaacttgttctcctgttgtcgtttgatatagatcgaacaacctcaaatattgagatgactcagactcaatttcttatcatgccatatcttatttggtgtggtagaaataattttagttgaaaccctattcagtacatatatagcagtcaaaagataatatctctaaagaaaaatagaaaggtttgtaaagctcatcatggaatgaaccatatctaataaggtctaatttcttcgttctgaaattttgttgagttgagacattccagatggagtttactgtgagataatgccatgttccttgagataatttaaaaattcttcgctaaagtattcacctcctcgatctgatcgaagaatcttaaaggctttctgatttgtttctccactttatatctgatttttttgaactttttaaagatctcagacttgtgacgcataagatacatatacccataccgtaaaaaatcatcgataaagataataaaatagagaaaatctcctctgatcggcacatcgaatgggctgcagacattagaatgtaccatagtaagtatctctgtggtcctttccctatgttctacaaagggcagtgtgatcatttttttctgaagatatgattcacaaaccggatatgactcagaagtcaacagactcaacagtctgatttttttcaatctgttaatcatgtcttctccaatatgacctagccttaggtgccacaaatacttttcttttacattatctctaggatatttagaacctatggcattcacattttgctcgatataattcatagaaacatctacatataactgaaagagactattgataaggaaaccactaccaactttattatttctaaaataaatgttacattggtccttaaagaaactaattacataatcttcttacattaagtaaaagatagaaattagattcctgctcgcagtaagtataaaataacagtctcttaataataaaatattctatcgatggtagtcacagaaggtacatttccatggcaacaacagcaatttttactccattttcgatacatgggatcatttcttcatcctttagccttttaatatccttaagatcctacaaagaagtgcacaagtgagtactagatctagagtcaagtacccaactagatgcagaaaaaatcattagatttatttctatgatgagtataccttcagaaggttcaccttccttcttgttcttcagtgttgccaggtaagcagggcattttggcttccaatgactgtcaatattgtaatagaaatacttttctttatcagtggccttcttctacaaaaccaccttcttctcattcttcttgctctctaccttctgtttctttataaatttttttttcttcccagtagactttctcttgaaagaagtccgctccatagcaactacaaagctctttgaactcttcaaggtttcttcaattgtgaccagcatgttcatcaactcgacaacggtgcactggatcttattcatatagaagtttacaataaactacccatatgaatcagtcaaagactacagaatgtggtcaatctacaagttcttgtccatggacatcccgagcttctcaagttcctcaagattcttgatcattgtcaaataatgatcatggactgactgcccatcatgcatcttcattttgaagagtcacttgaacacttcatagggagctgcacaactttgctcaccatacaacacttacaggtaagccagcatttatttggcagtccttatgtccttgtgttggcattgcaattcgttagacgttgatgccaacacgtagcacctaaccttattatcatcatccaaccacttctcatgagatgctctctgatcaacagtcagatggattggaagaggggaaaggtcctggtcaaggacataggtcaatttttcagaattcaaaataattttcaagttctgaagccaatccttaaaattcgatccgatcaacttattggtttcaaagattctagctgggggattggaagcagacattattcctatagagagtcaaaatttttggttaaattttataattgatttaatcaatttattttaaaaattttattttaaaaataaatttgggctcccaccatttttctcgaatctccacactctctgggtagagatacgaaaacctccacgatcaaaggcttctagcaggtgctacggtctcaccgattgacttaccagcttatctaacagttattgatgatggatcaatcgataagtgaataattcttgtttaatatttttttaaatatattacaaccaactccaatatttaattcatgaagcctcatcttgtccgaaatattggcccactccttagttaagtcatactcactgtttgtacaaaatggagccattattgggactctcaccgtatctgaaatcttaagcccaacccatctctatcccacagcatctcatgcctaatagtatagtggtatcttttcagtgcaactaaaccactatgtccaaccgagaacagtcaatcctaggaatggcccacataactacaatggtgaaagactgctagacttaatattttattacgaagatttgatttagggctctttcttaattagtcataacggttatgagtaacctagtggcatgggctagcttaagttaacaagtaacctaatacaaaatataatctttcaaaatgatcaggtaagttaagatgagtgggggttctcctatatttttcttaaataccaacgaattgatcagatcaaacaacggactcaattaatgaaccaccatctatgtactcaccttagacatcaaattgattgattaaaattgatcagattaacttattgacccaggctcgaaccattgagccaaattaggtcttaagttgatcgataacatatggctgttaatcgatctgatcaaactataactatttagattggtcatgagcaaatttgactccatcctaaccaatatttgattcagtttgatcaaccacttaaactagacctaaatgagctacctacaccctgaacccatgtattatgaaattaatttagatcttcaattctcaatttttagatctgtttaatttcatatattaattctgactttctgacctttttaagttggatgagtaatatcacctcatgatacgtgagggctgtacccattaatagcatgggttgataaccagaggtttgagaatggacggtctttcttttactcctagctattttcatattttaataagatgatgtgacgaaacctgagatacctttatgtgccttgttaggtcagtagatgagtgtaagtcaaattttggagagaagatcgataatcgagctcgtaccagatcttaggccaagcctaaggtacctttatgtccttgtatgcataactcttcagttagtacgaaattacccccaacactagccccctactttcgagttcgagtcataattagatcaggcgaagggaatatttctgatttactgaagacatgccaagattatcttattagtcgagatgacttgtttgcaactcctagtaagatgaagagtcacatcatcctggtgttttgtagccttttagttcatcaggatttactcgtcttaggatgagcggcatggttcaatctcttcctctgctttggtgggtgggcaactccggtgagtgggaagctctgacgttactcgacggagaccgggcatgcgtgcggaagtgcggccgctcgtgggagaccgacttcagcttggtctgctttggtgctgctcaagagcatgggaggcatacatgggcacatgagaaaacttggtgatgccgcaggctgcttcagcaccattgttggggagcatgggtgcgggagcaggtcggggctacccttggcggcctcgatgccaacagatgagagtaggtacgcacagtggagagctttagaccaccatggctgtccttcctctagcatcaatctgttgatgcaaattttcatcttgagatcggatcagttggagttgggcggcaatggcagatcagcaaccgtcaaacgacggtggtaggatctataagaaaagtttctaatcggaggtggctccaataaaaattctttgatgctcaagtaaaaaatccaataacagaaggaaaggagtgagcgtattaggagatagaagatcgcatacctgaagagtccctcttggccctctatatatgggcggaggctaaagagccatgagaggaaggaggatcaggcagttagtcttgcctagttgggtgagatatgtctgttatcctcctcttatctagaaaaaattatttattatttattccttatctatttttctttttgtcctctttcaatatccttaaagatcgtgcctgaccttctgacctccttaaattgggtgagcagtatcacctcatggctgaaggatcgggttggttcaccggatcgattcggatcagagtcagtagaattttaaaattttttgatccaatccgacacacgatgcatagatctaaatcagatttattaaccatttatatctatgtataagagagaagagaaatgtgataacgtttatcaccttgtgcgggtagaagaacaccgcaatccgatgatcagtagatccgaggttcactgttgagctgcatacttgtctaacctctacagatatccactcggatctggtctaggatgctttcttcttcttcaatccatctactcctagatggatctgcaagctccttaatcagattcaaatctgatctccgacagggctctaattgatgcttgatcacagccttctcgctccttgcacagatctgatggctttcaacacttcgaatccaccagatggtgtgtctaatacacttgaatatggaagagcttcagatattagagagtggagagggagttggcatggagagaatgggaggaggcaatgaaattttttatctcataaaaaaaatattcttatgatggacaacgccctatatatcttttcatctgatcaaattagatgcttaaaataagacttttctattaccgccccatctgattttctcccacattttatcgcacaaaactaatgagaaaagtcagatggcgtgaagaaaggatagggtggttatcatcctattcaatctcctctatttcgaattcaaacaattcaaattttgaatcaatcttgaattcaaatgagatcatatctcttatcctcatctaccaacggataagacttatcccactccctctcccttatctgaatttaggtgatacacatagatcaaatccatgtggtcgcacgtcccttccattggcgagaaaaattggatggcaccaacacttggcgccctcacaaacctaatctgattaggtcatgaattgaacttgggctaaccaacctttggagcccaattcaagcttgcttctatttggttaaatcctctaatagggaacccaaattaagtaggaaaaaataggtttgatcatgtgctagcatcgtttccttaaactcaaagctaggacttaattaatcctaactcaattagactacatttagttcaattgtgcaatccaagatcaaaatccttgtttatgtgatcccatagattcaattctatctggtaataagatatgctgcgatttctatcagcaatatcatgaaaattttttttgatggagaggaacttctttcaatttagtcaattagaattattgatcatcgaaataattttaattgatcctacaatctatcaattacacctagcagtatgtgatggcaatccagcagaactgaagaatgaacctctaggtgcagttatcgtatgatttggttcttctatcatgagtttcgataggatcaagatcaaggttaactcatcaaacctcatccctgtcatataatagaatcaattgattcaagtccgatgtgaaatccaatagaaacaactttctatctttcacagtgccatggccatggactttaggactcaatctcatgatctttataggactactctattaagatcaatagatctcatcttggtctaacccaatgcctacaatgaatatactataacgaacatacacctcaagatttcgtatgactagaagatcaagttatagtgtagtcaaactacagcaccctcaaggtgaatggttgatgcacctcaggtcagagaactaaatacatagctgcaattatgaacatgtcactgacgagaaggttgacatctttgtgactgttcgtgattgttcacgctcagtatctttattcttaacaagcacctatactttcactctggtatctccatatcgtagattcaagactcatctatctgaaaaaagcaatcatacaccaatcttttggatcgataactatctccgtaatgatcctacgatcgaaaataatttatgagttaactaaaattaatacatgtttcaaattcttaactcttgagaatatatgtaatcatacttattaacttaatggacgattcatagacaattaaatacaatgtgaatgaaaataatcaaattttattaatatcaaagttaattttataaattatgttcgaagaatgtattacaagtgtcagccaatgtggcttctaggacatacattcaataaactctcacttgtactaaagtcaattggctacaaatctaagtctcatttttttaaggtggacttcagtcttttgctggctcaattgcttgattagtggatcgccacattgtccgtagtgtcgactcacttcacttcgatatattctttctcgaggtaatcacagatgagatggaatcgtcgctcgatgtgcttgaatttctgatgaaacctcgactccttagctagggctatggcatcattattatcacagtagagagtaggacggtatctgatggcatcatacttagtttagcaacaaactttttgaaccaaaatatcttctttgcagctttcgatgcggtgatgtattctgcttctatagtggagtctacaatcacaatctgcttgcaactctttcagttgatagtaccaccattgcataagaaaatactttatgatgtcgactttcgatcatcagtatcagacataaagtctgaatcagtatattcgtgcactttatgttctctattctcaaagatcaaaaatatatccttagttcttctcaagtacttaaggatatatttcacaaatattcagttctcttcatctggattcaactgatatctgcttgcgacactcacagcatagacgatatcaggtcacgtacaaagcatgacgaacatgatgctccttatgattgaagtataagagattttgcttatacgttcaatctcttctgatgtgttggggcacactttcttagagagatgaatgtcatgtctgaagggcaccagacccctcttagatttctccatgtgaacctcttcagcacctcctcaatgtacatcttctgtgacaatcctagcatcctcctagatctatctctatagactttaatccccaaaatgaaggatacctcttctaggtctttcatgaaaaatttcttagacaacctaattttgatcgtgattaatatgagaatattatttttaatcaggaggatgtcatccacgtacaatacgagaaacatgacagtgatctcactaacctttatgaagacacaatttctcctcgttcttgatgaaaccaaatgatttaattacatcattgaaatgagcattctatcttcgagatgcttgcttgagttcataaatggacctttgtaatttgtaaactctatgatcactattgttggaagtgaaactaaatggctatttcatatagatatcttcctcaagataaccatttaagaatatcattttcacatctatttattatatttcataatcgaaatatgctgcaatggcaagcagtatgcggatggacttaagaatggctacagatgaaaaggtatcttcatagtcaataccttcacgctgactatatccttttgccacaagtcaagctttaaagatctctacctttctatctgcacctatctttctcttgaagatccatttacacccaatagataaaatatcttcagatgaatctatcaaggttcagatttggtttgagtgcatcaagtcaatttttgacttcattgtctctaactatttttcagagtcaacatcagatatcgccttgctatagattttgaggtcatctccatgtatcatattttctgtgagaaatattttctctacatcctctaagataatacctaggtacctcttaggaggatgaaaaatcttactagacttacgaggtggaggaggaagtgtgtggatcgactcagactgaatgggttcctcaaatttcaaggctcgctactcttcagagattttttcctcaagcctaatctatttttccatgcctccatcttgaataattattttttaaaaaagactgcatgttgattcacaatcacattatgattttctgaaagatagaaataatgtcctaatgactccttaggatatccaataaaatgagctctaaggaatctgatttctaacttgtttgcctgttgtcttttgatatagaccgaacaaccccaaatatcaagatgactcagactcaattttttatcatgccatatctcatatggtgtggtaggaacagttttagttggaaccctattcagtacatatatatatagaggtggcaaaaggatcgggtcggtcataaacaggtcaggtcataaacggatcgagtcagaaaatgatcaacctaaatccaatatgtttattaaatggaacaaaaattcaaacctgaatccgatctatttattaaatagataatccgatccgatctatttaatctatttattaaataggtcaaattaggttaaacgggttaaataggttaaacggattaaacagattaaatgagttaagttaaatggatcagaaacaggttaaacagattttaaacaggttaaacagatcttaaatgggttaaacaggttaaacaggtcgggttaaatggatcaaaaataggttaaacaggttaaatgagttatctgactcaacccaatctaaatattaaatgagttaaatgggttaaatgggtcagatatctaaaattcatatccgacccacttattaaacgggttaaacgggtcgatccatttatgaccagaactcatttagcctaaatccaaacctgtttatgacaaatcgaatacgggtcgggttggtaggtcggatcatattttgctggccctgcatatatggcagtcaaaagataatatctctaaagaaaaatagaaaggtctgtaaagctcatcatgaaatgaaccatatctaataagatccgatttcttcgttctgaaatttcattaagttgagacgttctaaacggagtctactatgagataatgccatgttccttgagataatccaaaaatttttcactaaagtattcacttcctcgatgtgatcgaagaatcttaagggctttctgatttgtttttccactttatatctaaattctttaaactttttaaagacctcagacttgtgacgcataagatatatatatccataccgtaaaaaatcatcgataaagataataaagtagaaaaaatcttctctgaccgacacatcgaatgggcagcaaacatcagaatgcaccatagcaagtatctctgtggtcctttccctatgtcctacaaagggcaatttgatcatttttttctaaagacatgattcacaaatcagatatgacttagaagtcaacggacccaacagtctgatttttctcaatctgttaatcctgtcttctccaatatgatctagccttaggtgccacaaatacttttcgtttatgttatctctaggatgtttagaacttacggcattcacattttgctcaatataattcacagaaccatctacatataactgaaagagactattgataaggaaaccactaccaactttattatttctaaaataaatgttacattagtccttaaagaaactaattacataatcttcttacgttaagtaaaagataaaaattagatttctgctcgcagtaagtacaaattaacagtctcttaataataaaatattctatcaatggtagtcacagagggtacgtttccatggcaacaacagtaatttttgctccattttcgatacatgggatcctttcttcatcccttagccttctaatatccttaagatcctacaaagaagtgcacaagtgagtattagatccagagtcaagtacccaactggatgcagaaaaagtcattaagtttgtttctatgacgagcataccttcagaaggttcaccttccttcttgttcttcagtgttgccaggtaagcaggacagtttcgcttccgatgactgtcaatattgtaataaaaatatttttctttatcagcggccttcttcttcggaaccaccttcttctcattcttcttgctttccaccttctgtttcttcacgaatttttttctcttctcagtagattttttcttggaagaagtccattccatagcaagtatagagctctttgaactcttcaaggttccctcaattgtgaccagcatgttcatcaactcgacaatggtgtgggaattttagtgcaggggtaaaacggtaattttaaaattttttcaaaattataattttacagtgaaaattattaattaatctaattaattaacatgtattaatcctacataaaaatctaaatatgatatatatagcatgtatttaaatttaaaattttaaattctacagtaaatattttactgttatgtgttcagaacacattaccttcgtacaggtagtcgatcgtcgtagtttgatcaccgtcggaatgatctgatcatcgtaatatagccacacagtatgtctgacctccacggatcatccacacgaagctccaggtctgatcggctccttccgaatgctagttcgttgcagaaccctttcgacggccgatgctgatcgaactccttcgatcggtgtctgccgactcctcaatgctctagatagtcagcaaaggtgcttgagaggttgatgaagctcttcctgaagtttggtgggctcacgacactcgcagctcaccttttcacttcccgaaccctaggcagaaatcctaaggtactaacagatgaccctgcgccctttctctcttcttttcttttcttttctcatgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacaactgtcgacaggctgacgattgattttgggacactattcccaacaaatggtgcactgaattttattcatatggaagtagtcacttgaacacttcatagcaagctacatagttttgctcgctatacaactcttgcaggtgaaccagcatttatctggcagtcctcatgtccttatgttggcattgtaattcgttagacgttgacaccaatacatagcacctaaccttgttatcatcatccaatcacttcttatgagatgctctctgatcagcagtcggatggattggaagagaggaaaggtcctgatcaaggacataggtcaatttctcagaactcaaaataattttcaagttctgaagccaatcctaaaaattcgatccagtcaacttattgatttcaaggattctagctgagggattggaagcatacattgttcctgtagagagtcaaagtttctagtgagattttataattgatttaatcaatttattctaaaaattttattttaaaaattaattggggctcccataatttttctcgaatcctcacactctctgggtagagatatgaaaacctccgtgatcaaaggcttctatcaggtgctacggtctcatcgattggcttaccagcttacctaatagttattgatgatggatcaatcgataagtggacaattcttgtctaatatttttctaaatatgttgcaaccaacttcgatctttaattcatgaagccttaccttgtccaaaatattggcccactctttagttaagtcatactcaccgtttgtataaaatggagccatcattgggactctcaccgtatctgaaatattgagtccaatccatctctatcccacagcatctcatgcccaatagtgtagttgcatcttttcgatccaactaaactactgtgtccaactaagaatagtcaatcctaggaagggttcgtataactacaatggtggaagactgctagacttaatattttattacgaagatttgatttaggtctctttcttaattagtcataatagttatgactaacttaatggcatgggctagctcaagttgacaagtaatctaatacaaaatataatcttccaaaatgatcagataagttaagatgagtgggagtccctccattgctttctttagatacgaatgaattgatcagatcagacaacagactcaattaatgaaccaccatctatgtacttgctttagataccagattgattgattagaattgttcagattagcctattgatccagactcaaactattgagctgaattaaatcttaagttgatcgataacatataactgttaattgatctgaccaaactacaactatttagattgctcataagcacatttgatcccattctaaccaatatttgattcaatttgatcaaccactcaaactagacctaaatgagctacccacactttgaactcatgtattatgaaattgatttagatcttcaattcttaatttttatatctatttaatttcatatattaattcttaattaagtccatgggtctaatcatatgtctaaataatttagattaacattgtatcacataaaaaaatttctgctcaccctcgagtcgactcgccctagacatgagtcgactcatcacagcgagtcaactcgagtctgaactatgtcggctcatctgcaaaccaagctggctccacaggattttgagtcaacttcaatgaaaaggagtcgactcgtcagggactcgagtcgacttgaagaagaactaagttgactcaatgggcataccagcaatgaatttcataaattttaacgatctaagcataataaaaaaattttaatttaaaaattaaaataattttaaaatttaaacaactaaattatgcatcaaaatctaaaatttttggatctaagattttacagcaaattaagtatttcctttcactgttcttcttcatgggatgtaatcacacgacatccctatacatcataacagaatctattgattggacaagagagagattttaatctctattttttcttatgatcggatggtctggtgataaatccatttcgagtacttggctactcagactttataactagatctatgcatatatctcatatatcagaatagatttagtctaaatacatgcttgtgatcaaatcaaactacttttagatctatctaaacatgctgaaaattaaatctaatctaatattatcagatttgatcactactttagatcacatctgaatcagatctgatccgatctagatttatgatccgtagaaccttgctctgatatcaattgaaggatcggattggtgcaccagatcggttcgaatcagaggcagcagaattttaaaattttttcgatccgatctgacacacgatgcatggatctaaattagatttattaattatttatatcatcatataagagagaagagaaatgtggtaacatttatcaccttgcatgggtagaagaacaccacagtttgatgatcagtagatccgaggttcgctattgagctgtgcatttgtccgacctctacaagtatccactcagatttagtctgggatgctttcttcttcttcaatctgtctactcctagatggatctgtaagcttcttaatcagattcaaatctaatcttcgatagggcttcgattgatgcttgatcacagccttcttgttcgttgcataggtctgatggctttcgacactttgaaaccactagatggcatgtccaacccacttgaatgtgaaagagcttcagatatcaaagagtagagaggaagttggcatggagagaatgggaggaggcgatggaattttttatctcataaaaaaactactcctgtgatggacaacgccctatatatcttgtcatctgatcggatcaaatgcttaaaataagactcttctattactgccccatctgatttactcccatattttgtcacataaaactaatgagaaaagtcagatggcatggagaaaggatagggtggtcatcatcccagtcaaactcctctattttgaattcaaacaattcaaattttgaatcaaccttgaattcaaatgagatcatatctcttatccccatctatcaacagatgaggctcattccactccctctcccttatctgaatttgggtgacacacatggatcaaatccatgtagtcgcacatctcttccattggtgagaaaaatggtgtggcgccaacacttggtgcccccacaaacctaatctaattaggtcatgaattgaactagggctaaccaacatttggagcccaattcaagcttgcttatatttggttaaatcctatctaataggaaatccaaattaagtaggagaaaatagatttaaccatatgctagcatgacttccttaaacccaaagttaggacttaattaattctaacccaattagactacacttagctcaattgtgcaatccaagatcaaaactcttgtttgtgtgatcctataggtctaattttatctggtagtgagatatattgtgatctttatcagcaacatcatcaaaactctttttgatagatcaaaactccttctaattcagtcaattagaattattgatcatcaaaataattttaattgatcctataattcactagtgacccctagcagtatgtggtggcaatccagtagaactgaaaaatgaatctctaggtgtagttatcatgtgattcgatttttctatcataaattttgacaagatcgagatcaaggttaactcatcaaacctcatcactgtcatacgatagaattaatagattcgagtctgatatgaaattcaatagaaacacttttctatctttcatagtgccatggctatggactttaagactcaatctcatgatcttcataggactactcctctaccaaggtcgatagatctcatcttggtgtagcctattcctacaatgaatatactgtagtcaacatacacctcaagacttcgtatggttaggagatcgagttatggtgtagtcaaactacagcactctcaagatgaatgatcgatgcacctcaagtcagaggactaaatatacaagcacagctatgaatatatcactgataagaatagatatcattgtgactattggtgattggtcatgctcagtactcttgttcttaataagcatctgtattttcactttgatgtctttataccgtagattcaagactcatctatccgaagaaagtgatcatacatcaatctttcagatcgatcactgtctctgtaatgatcctacgatcgaaagcaatttatgagttaactaaaattagtacatgtctcaaattcttaactcttaaaaatatgtgtaatcatacctattaactaaatgaatgattcacaaaaataattaaatataatatgaataaaaataatataattttattaatatccaagtcaattttacaaattatatcctaagaatgtattacaagtgtcagctaatatggcttctagggtatacatccaacaacggcatacggggccacacctattaattgtatgaactaacagagcttaagttgggtggttgtggagggtttgctttgctttactcatgaccattctcatttttaaatggggtgatgtgatagggctataaagaggcctcctaaggatcaatggccaaagctgggggtgaaggccaatgctgggatcagtagtcaaggattggtcggccaattgatgatggctgattagaggtgagatgtaactggacggtgaacctccagccagaagaaagtcgcaggtcatggaagatcaaggaaggtcgatgattaattgagggtggatcgatcgatggagaaatcgctcgaaatcactcgctcaggttgcggtgcagtgataaaactggggtcagcagtcgatgcagtggccaaagccgtcatggggctcgtgttggaatttgggatttaaagcatgcatatgtatttcaaaaatttaattttctaaacaccatagtggagaataagattaaaataattttagtctaaattttgtatgcataaaaatataaaatcatatggatctatttcatatgctgaaattgatatatgctgaaatttaaattatgatcaaatcacatacctttttcataatctctttcttcaaatttggatctggaagagacgaagctctctattagccacacaagtgtccgatctctatgagtatccactcgagatcagcttggaacaacccttaaagatctaaattttgattatctaaaattcagcctactgaatctgaacaaagcctggatcacgatcaatatttgatctttttccttgatcttcatcttctcttcctctctagcctttctccttgccttgtagtgctacaagagaccacgaactagcagatgaagggccgcccaatgccttgggcatgtgcaaaatttgggatgcgcgtcccaagtagtatggcatggggacacctaaggagaagagaaaaaaggaggaagagagggcgtgggaggttctcttggggtggagaggagctggcttgaatgatcttaggactttagaggaggtccccttttataggcataaagattgaatcctattcaatcatataatacaagtcctacttgcattaggattcttattaacttaagtgatccaacttacattaggaagtccattaggtgccaactattggagcccttgcacccaagagacaccttatatgagaactaaaggccctctaatcaatgaacacatccaaattgaataatgcaaagtggcgtcccataataactatcaaggagattcataagggacttgcacccttaatttatgtgatccataaccttaaacacccaataattggagtctcatgaatcttattcatgtaggtaattagcagataattaagttagaattaatttatcaaataaataatctcaacaaaaagagaaattgggtccaaccatgtgctagcaaggttatcatgaacccaatggatttctctaaactcaattaatacttcataagctcaattttttattctagacctaatctctttgttgtgtgacctcataagttcaattctatttgatagtgagatatacaataatttctattattatattattgaaactcttttcaatgggtcaaaataatttcactctaactcagcaaggattgtcgatccggaacaatcctagtgagctctcacaatccaccagtgacacttagcaatatgtagtggcaatccagtagaattgaaatgaacctttaggtataattaacgtatgattcagtccttctatcatgagtcccgactagatggcagatcatagataaatcatcaaatctcaacatcaatcatatgataaatttgattagctcaagtccagatatgatgtctatgaaaactcttttccatcaatcactctactgtaaccacagattcatgaatttagcttctcaaatctcataggactacttctctctatcaagattgatagatcccatcttgatgcgcactccactcctacagcggatcaactgtcgccaacatccactataagggttcattgagatccatatttatgtgtcaatcaaactccagtagcctcactgcgagtagagtaccgtctcaaatcaaaagatcagtcacataactatagcatcgagacaatcactgatgattgaataaaaatttaagtgatctctcgtatagtcacgctcagtgctagttattctctaacaaccatccgtacatatcatcctatgtctctacacagtagattaaagatccatctatcttgaaagaagcgatttgtgtgtcagtctatctggatctatcatcaccctcatgatgatcctatgactagaagcatttaggaattaaatgcgtgtctctaattctcaacactttaagaatatgtatcgaagctaatttcatggatgattcaaggacacatcacacttgaataaaaaagaaatcatctcttttattgatcatatcaatacattaagtataaaattatgccttagatatattacaatgtgtcagccatattggcttttaagacatacatctaacagctcgtaggccatgtgcgactagcttgtccaaagctcccaaatgactctggtctgagcccttaggatttaatggcttgatgtgactatacttggtgtacatcttgatgtctccataatgatctaatttgaaaggagcataaggaagcttgctgtcaatattttctagttcaatgggtagagcgaaagacaactgggatggactttattggcagaagcataatgatttttgaagtggtgcgaaagtcgaggcatgggctgaagaccatcatctcacatgttctgctagtacaaaaatacccccaatactagccctccaaattcgagccttggttcagatgaagagagtgtaccagatcgaacttgtcgaagacgtgccctttcatgtcacttgaactcagattcctttgatttcatgttaaagtagtttgagggtctttatcctttaacttagatgactatagaatttgagggctccgagctgatcaaaagctccttcagttaggccaatcaatgaccatttctcattgggccgatcaaaagccattccttactgggtcgatcaaagaccattccatgctggggacctttggaagggctttccttactgaggtacaaaaagggccgttgaaagaacctctcccttattagagccgttggatgggccttccttactggggtactgaaaggaccgacaaggcctctcccatggggtatgaaagggccaaccgatctctctctattttggtattggggtgcaaaaaggccaactgactgttagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcaccgagaagttcgtcttcattttctgatgggttgccatcatatactactaggtgtcactgatggattttggaagtaattagaataatcttgatgattgatcattctaattatctgaatcagaagagttctggtccattgaaaggagtttcgatgatgtcgatgatgagatcacgacatatctcattaccatacggaaataaacctaactggattacacaaacaagagttagtgtctggatgtcatcaattgagctagcccagtttgattgatttggattagatctaattaggttcaaggaaatcgtgctagcacacgattgagcctaactttctcctcgtgtaatcttttctatctcaactgagccaaatatgatttgactcttccagagaaccttgagaagatttctctcagtctgactggagccagtccagctcaaaaaaattttgtcttaatttatgagatgaatttaagacaacacctgctaatttctgtcacctgccatttccattttaggacatcgatcaaacattgatccatggaccgtggactgaaggctacttggcaagaggtcattggagagtttttgtggagtgtccacctgctaattttaccctcaaagtgggtgccataatcagatatggcgtgtaccccaagtggataaggatagggtcctatgagatgagaactctatgccttgatcgactcaaactgttgggcgtcaatctcactatgtttatccagtgttggcaccaacagtaggagaatttggtggagttcttatctgatatgatcagatgacatcactccatcaattaaatttttttcaaaattaattaaaattttttgattgatcgaatgatgtggcactgcatggcgcagcagggtttatttaaatcttgtctgcgcctagggtttagagaatctgctcaatacctagcaaaaatatgaaacccctccacttctctatgccccctctactcctctccctcccctctttacgtccaagaggttggacatccatctggtgcttgtccaaagtgtggtggctctctgatcagaaggctgcagggatttgtcgagaagctgctgctccagctttaaaagatcttttgaagatcttgcagatcagatctagatctaatttttggagcaaagattcgcaaggagaagatgatctagatcctacttgagtggataccgatagaggtcaagcgactacgtggctattttagaacctcgagcgttgttgcgatcatctatagggtaatctagttaccctagaggtattcctctaatcctcaaattttagatttaattttagattaaatatcaaataataaaaattaaatctaataaatcttagatctaaaataaagtaggataatttttttaaaaatattccaccccagatctcattagatctggaagatcctacaagaaaaaagtcagtttttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacataagatgcagtgaccttggctaaattaatgaacatgttggttacggctgagctttctttgaagagtttaaaaggctcagtccttactgtggagcagacttcttccaagagaaagttttttggaaagaagaaaaagtctgcgaagaagcagaaggtggatgaaaaaaagaagaagacggaaccgaagaagaaggctgctgaaaagaaaaaatatttccactgcaattcagacaatcattgaaaatgaaactgtcctcagtacctggccaccctgaaggacaagaaggatggtccttctggaggtatgctcattatagaatctaatcttacggtttcctctgcatccagttgaatacttaactctgattctagtgctcatttgtgcacttctatgcaggatcttgaggagagcaggaggctgagggatggggatatgatcttacgcgtcaggagcggagcaagagttgttgttgtggctgtagaaacctaccctctgagattatcgttaggattagatttagttcttagagactgttattatgtacctgcagtaagcagaaatttgatttctgttttatgtttagcacaagaaggctatgtgcttaactttcataaggactattgtaacatattttatgaaaataataaagttgcaaatggttttcttattaatggtctctatcagctacatattgatgtatctgtatttcatatcgagcaaaatatgaatgccatggaaattaaaaggcctagagatagtctaaatgatagatatttgtgacacctaaggctaggtcatatagcggaagacagggttaacaaattgaagaaatctgggctattgagtccgttaactttcgaatcatatccagtttgtgaatcatgccttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgaggtagaaaaacaaacaggaaagtacattaaggttcttcgatcagatcgaggaggtgaataccttagtcgggagttcttagactatcttaaggacaatggcatagtctctcaatggactccacctggaatgccacaactcaacggggtttcagaacggaggaaccagaccctattagatatggtccgttccatgatgagcttcacggacctccctgagtttctttgaggatattgtctcatgacagcaatatatgtattgaataagatttcttctaaaatcgtttctaccacatcgtatgagatatggtatggtaagaagccaagtctgagttatctcagaatttgaggttatccggctcatgtcaagagatagcaggcggataagttagagtttaggtcttttagagctcgattcataggatatcctaaagagtcattaggatactatttctatatttcagaagatcacaatgtgattgtgaatcgacatgctatttttcttgaaaaacagtttattcaagatggtggcatcggaagaataattaagctcaaggagaatgtctcccaagagcaacgagctaaagaatctgagaaatccaatcaattagaaccagtcccaatacagtctcttccacctcatagatcgattagagttttccgtcctcctgaaagatacttaggtactatacaagaggaagtagagaaaatgttcctcatgaaaaatggggctcatggtgatgacctaaagacctatgacgagacgatatcagatatcgactctgagaaatggttagaggcaatgagatcaaaaattgactcgatacacttaaatcaagtctaaaccttggtagatccacctgaaggtattgtacctattaggtgtaaatggatcttcaagagaaaaataggtgcagatgggaatgtggagacattcaaggctaggctcgtagcaaaaagttatagtcagcgcgaaagcattgactatcaagataccttttcatccgtagccatgctaaaatctatccgcacattgcttgctattgcagtctatttcgattatgaaatatgacagatggatgtgaaaacggtattcttaaatggatatcttgagaaagatatctatatggaacagccgcttggtttcacatccagtgatgatgatcacatggtctgcaagttgcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgaaaatcttgcagatcagatctagatttgatttttggagcaaagattcgtgaggaaaagatgatccagatcctactcgagtggataccagtagaggccagacgactgcgtggctattttagaacctcgagcgttgctgcgatcatctacaaggtaatctagttaccctagaggtattcttctaatccttaagttttagatttaattttagattaaatatcagataataagaattagatctaatagaccttagatctgaaataaagtcgtataattttttttaaaatattccgcctcagatcttattagatctggaagatcctacaagaaaaaagtcgattttttccttcactgacctctcccttggggcacgaaagggccaacgacctctctccattttgatgctggggtgcaaaagaaccaatcggcctctctcctggggcacgaaagggccaactggcctctctacagttgggtgctggggtgcaaaatggccaaccagcctctctcctgaggtacaaaagggccaaccagcctcttcctatttgggccatccgattctgatcagcctcgtcaagtcggctttctcgatcgaccttctagggtcggtcttatcagatcaactttctcgaccgtttggcgttggcctcgtcagattagcttccttggccttctagagtcggcttggatttgagctacagatcggtcttttttgactttagattgatcttgattctaattttgattggcctggatctaggctttgggtcggctttgatttttgccttggcttagacttcattcttcctctcagctcggacttgactttttcctcggcttggatttgattttttctttggctcagccttaattttctactcggctcaaccttcattttttcctcaactcagacttaactttttctcctcggctcagatttgaatttcatctcggcttggccttcattttctactcggctcgaccttgattttctcctcgattcgaatttgatttttttctcggctcgatattgattttctcttcagctcggccttgatttttttctcagcttagacttgactttttctcctcagtttggatttgatttttttcttggcccaaccttgattttgatgtcctatggtcatgcgagaaggaaggagaagaataatggatggaagcttaaaagcctcttactatgagttttttgtttgagagcccttgggttctgtttgaccccttcttgttatttacctgtatttgagcttgatctttgctttagattgaccttatttttgcttcagtttggccttgatctgcatgttggatcactttgattttgactttggatcagactctgtctctttcttcttcctcctctttttctttttttttttggaccagtttggcctcgacaagcgggaatcacggagccaccgatctggccccgataccattggaagagtgtgtgggtgtgcagagctgctcgcgggcttgccaatctggcctcagcaccaacaggagcatgcatgcacacggagggggcatggggccgccgatctggcctcggcactggtggggcgcatgcacgcaggggaggcccatggccaatgggtggagggagctaaccgggcccgtcgatgccgaccttggaactgtcggagatgcatgggaacgcagggggcatggagccgctctcgggaaccgccgatctggcctcagcgtcatcggagaagcacgggagcatgcgggaggcgtcatccaacaaaggggtgcatggaggcggagtcagccaaaggacgggcattggagagccccggggccgccaatccaacggagttcaccaatctcacagggctcgacctgcatgggtgtgtgggaagtgcacggaaccatcgatggaggagagcaggcacatgcacgaagtgcacgaaaccatcgatggaggagagcaggcacatgcacggaggcgatgatgtcatcgatcttggcttcgatgcggctcggagaggcttggggccgccaatctttccttggcacgcgacggggaagtccggggccgtcagatctagttttgacattgggagaggccgcgcgaaggtgacgaagctgtctccagcatcgacggaggtgtgtatgcacgcagggaaggtcagtggccgccggtctttttcccttcctccccacttcttttcttctctctttcttttattttcttttattattttttttatttgtggatgtctcgatctctttctttattttgatcccaccaaaaattcaaatttaaattctaaatatgaacaaagaagaaaaagtgatccaagaatcaagagattctagtaattttctttttctagaagttatggtctccttcctcatttggggcttccttcttgattgggatctctttttttgttgagagccctccagttttgagaccgacgaggatgatctcggggccattagtcaatgtcagctagttcatggatggtcggaccatctggctaatttggaggtggacgatgagatctaatcggcattgaagcagtgcaatgaaaactcttcgtattgagcatctgctcctttccgtaaattggcttgattcttcctctagcaccaatctgttgatacagattttcgtcttgagatcggatcaacgggaattggacggcgatggcaggtcggcaatggtcggacgatgacggcaggacctgcaagaaaagtttctgatcggaggtggctccggtggagatcctccgacgctcaaatcagaaatctgacaacagaaaggaaggaatgagtgtgttgaaagcgaaaaaaatttcatcccttgaggatctcctataagtctttatttatagatgaagattgaagagtcgtgataggaaagagaatcagatggttagtcttgatttatctagagagatatagtcattatccttctcttatctgaagaaatttatttattttttatttcctatccgattttctatgatcacgggatttgaagttttgtgtagggttggatctttcaatggtcgatgtcaacttttaggtgactttttaaagtcagaagaggggtagagagagatcgtcaaagatctttttgccttcattgaatatcctcgaagatcatgtctaatcttctgatcttcttaaattggatgagtaatgtcacctcatggtacgtgagggccgcatccattaatggtatgggtagacaacctaaggtttaagaatggatggtcttttttttactcctgactatttttatattttaataagacgatgtgatagaacttgagataccctcacgtgtcttgttaggtcggtagctaggcgtaagtcggattttgaaaaagagatcgatgatcgagctcgtaccagatcttaggtcaaacctgaggtacctttatgtctttatatgcataaatcttcagttagtatgaaattatcttcaataattaatactgtcattttttttcaatttatgtggggcaatcgatgataatgagattagcccaaaattattatccattcaatcaagttcatatgcatatatcaattttttcattttcaacttttgactaaccatggctgcattttgcacccatgatggaccaaacaataaaaaccatgtttccatttgtgacgggacaatcgataaattttgtatttttcatccgtaatagagcaatctatataatacgatctgtccaaaacatcacatccatttgtctaattatgtcaatatcaattaaactaagatattaatccagcgtaccatcaatcataggtatatatgaaaaaatataatttaatacagaaaaccatcataaaaaaattcttgcattttgcttatctgacacatatacatatatgtacgtgtatatatgtaggtaggtacaaataatatacatatatacacgtgcgcgcgcgcgcacaaacggataacgcgggaaatgactattggagtggtgcgcgcgcgcgcgcaaagggataatgtggggaatgactattgaaggagtttaccggactcggtccaccaactaatcagacagagagcagagaatggcattaaggtgattatggggcctgtcatgccagttgtgacgaccatccaatgccaactcgccttccagttcatctcagactttcccatcgccaaaaagggctgcaaacaaaacatactgatcctccggtccgctcccaaactagccgaattcgcccaaccggctttcaactcggtcgactcggtcatcaactcggacttgggttccattacttctgaagtcctgagttctggcgacttggaggtgtttttttgtgccggaggcgtcccaggtggaggagacaaaaacggtcactaacggtctgaatcccaaaaccgtggtgccgttcaactccaagtgggggtttgaggaagaaaaggatttggatgggggcatggggagcttcgtcgggtctttcgacgtggtgtatccggtcatgggattggaagtgagaggagttctcagcagaaggaagggcgtggtgttcaagtgtgtgagggatggggtgttgagtggggaggggtgggtggtgatggtggaggaggaagggaagagtggggagttggaggtggtttcgaggtttaggaggcggcagtccatcgaggagacggtaaagaggtgaggcagtgaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggactccgtttttcgccgcgaacctcgctgtgggctgaatctcgaggcgtcaaatcctaacatgtttctttaaagttttgcactcaagtatggccaatctcaatgtagaatttcttatgtgaatggatttatgattgttttgtttatgtagtttagtgatcatgtttttatcttcttgtttcggggtagggaaatgatcggctcctgcttatacaattggatgactgcagtaacatttgagtcatggttattgtctcaaaaacaaaaacatttgaggcatggttcacacataatgtttagattcataatcgtgttgagcctctaggaaaattatgcggtcctaacctctgaatgtaaatagatatacggattcactttgtgttttcatgttactcaaaatgaccatttatttcaagacgaaagtagcatatggcaattcttttctaatatttttatagaagggtaacgaaaatgaatgatagctagtagatataggaggtttctcgtcacatgaaataaatttaagaaaaaacacaaacatcacaacctatatttaaaaaagtccgactccatcgtaaacatgctagtccttacctgtaaaaatgagctattatggtgccatcttgcagatccactactgggtgcggttgcaaccaactgtttgatttgatggtcggaggaacagtggagtgtccaaagaaacggaagattagaacagatccttttgggcaatccacgagcaatacatggatagaatagttgtgattgcaagactggacctctttcatcaaattcaatttggagagaatctaaactctttcaacgtacggctctctctcaaggagaagcaaaccaagatcagatcaagtggcatccggaaccactgcaaacttttcacaaagatcatatgacgcatttttaaatacgtatccctaggcctcttcactaatctcccgattccattctccattcatttgaggcagagggagttttaatgccatgttggacagggaatggaggggcattatagttgtgcagctaaccttttcttccaaaaaaaaaaaaaaatcatctgtaaagcaggaatctacctcaaccgacttactgaggtattttgaggttcacttccaacacagactcataatttggtcaacttggtgggctaaaatgggcctgaaagtgacaatccttgaactatcctcgtttattcatggaaggtaaaacacctccatcatcagtttgcccctcaaacctcccgactgtgccctcttaatacctattatctttttttgcactctatagcaatgtaagaagcttcgtttctatctacttcccttacacctatggttaaaggtatgttggcctgggtgtcttgatataaggactggatttgaatacaattgatcctaggttattacgatcattatgtaagttaggcaatgcctttctcagtgcaacatatggcttgaagttatttgcagaaaatttggatcaaaatcttctcgagagatttaaccataagctatttaagaatatgtgaaagatcttccgacgtggtgtgcaagtaacttagtttctcagtacagctccaatgaaccgactaatgtattgcaggcacttcctgttcacgtgtttctctactgtgcttcccaaggccatgcagattcccagttgggctggtaatccggacttaactacacagccaaggatccagcatattgtattttctgactttatttgacgtattcatatatttgatgtattcatactagacagtaacaacatatccgttgtataaaaaaaaaaaatccagacttaactagagcacatgcagctggcgtataaattgaatgcatacctttagacatccatgaaagaaacaaaaaaaccattcgtaacaaaggaaaactggatgaatccattgatcgaaaaagaaaaaggaatatcttctatagagcttagccaattacatgttacaaaatcagccaatgaacatgaatgtcttacccaagaaaaaaacagagaagagattttttttttttctttttttgagtaaatgatggaaagtccaacccgcatttgattaaaataatgaaatgaaacaaaaggaggggtagagacaagcaccagacctgcaatacaaacaaaacaaatcccctgcaaacaaaaatcaaaggaaccaccagaaacagaacctcaggccctgtgtactgcaatgaacctctatacccctccacttccactggaacaaattagaatgacatatctgtttaatgagagttccatcaaaacaaaaatctgtttaatgagagtagtagtttacaatttatttttaattcaataaaaaagagagatagaagtagaccacaaattcttttttgtttggtctatttccagatttgtgccatgctaatttttgcatatcaatttcagtagtacacttaatgaaccttttatcatgcaaagttaattgagctctcaccatccaccactattgaggctacattcgcttgagacccctgtgagcgcatctgatttgctgatagtgccactttcaacccagaaagaaggcactgaaggggttggaagagtaacagagttagtaccgagcatcagaacgactgatgccatgttgggtctcttttctgggtctgcttgaacgcatagaaggccgatgtgaatgcatcttaatacttcttgcaatttgcaccgatcaactagactttggtcgatcacctgtggtgcctttcctttgttccatcgttcccacacctgccgataattggtttaaaagagttatatagcacaacttgtgttgcccatgcaattagaggattctaataaatataatctacattagattattcaaaatcaagatttaggaggacgaatgcttacatagcttggaagatctatcgcacgccctgatccttcaaaaccactattccttcgaccggtcactatctctaaaactaatacaccataactaaatacatccaacttggtagataagtgcccacgcttaacatattctggtgctctatagccactgccatagaggaattacagtatgtgagctccattgttggatggtacttatgattcaagtttaaaaaaggagtccaggataaaatttttattcttaggattttgtgatgcgtttcccatctttgtatcagaacaaagaaaaaacattcaggcttgtacttaccatgtaccagctgccgtgcaattgctttcatgggtttcatccataacaaaatgctttgcaagaccaaagtcagagattttagggttcatatccccgtctagcaaaatgttgcttgcttttagatctcgatgaactatccttagtcgtgaatcttcatgaagatagagaagccctcgaccaattcctttgatgatcctgcatcgaactccccattctagtcgcttttgtctggtgggatctgttgaaacaaagtacaagttggccaatggaaggaccaatgaggctgcatcatatatgacgagattttgcagcatattccgaggtgctataaacatttatgcaacaccgaaaatggtaaaagctatttgaatgcagagctcttcattaaaaaaggaaaggatatctacaagaattttaccatgaatcattagaaaataaggctgcagacataacagcaacattcagcataaattattattagatcaggaaacaatttgttgtagtcagatgtcatgcctgatagatggaagaaatggaaattacagaaagcgttcaagaatatgaaccactgaattgaatgcaatagaacaatatcgacatcctcaagagctgacaaaatttttaaataacatgcgtctgtaaggtagcatacagggctagtgacaaatataaacccactggttgatagcgatagttctattctttttttttttttcttttaaaacacctcttgggcaaaagatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggaagcacttagataatggatcataccgaatagaaatttgtcaagacttccgtttggaagatactcatatacgagaagcttctcttgctcttctaagcaataacccaacaaccttacaaggttcctgtgctggagcttagcaaccaaatcaacctcatttctgagctcttttagtccttgccttgagcttactgagagcctcttcacagctacctcttgttcatctgatagtattccctttattgcatttcaacagcacaattaagagtaatattttggtcaagttgaattttgatatctgtatagttctccagataaaagtgtcagtctttaagaattaatctaggggataccttataaactggtccaaatcctccttgtccgagtttgtttgcatcagagaagttatttgtcacagttcttagggtttccaaatcaaatattagagattctgcacttctggtctccttttcagcttcatcgtctgctcgcatttaagacacacatacagtcaaactccacattcaatgatgtagtgcatgcgctaagcaaatccagtaattttttaaaacacatacgtacatgatggttttctagctagtttctttcgtcgcaagtaaatacagatggcagagagtagcaacaccactacagctatagttatcgcaataacaacaactattttgattgcgctaccagcatttcctgaatcaagatgagagcaaactagttaaaatcatgtttcgagatcaaaaaaataaataaatgaagagcccataagataaatcatgatgcatatcaacacacacttgtaatgttcaattagtctaacctagcagtttttgggaaaaattggttatttgttatttcctatattttttatttgttaaaaataattctttgtctatagggataattaagggtttttttttttccttgacatggcaccatttggaaacaactggatcagtcctgctggttctgcgagaatcagaacaactgcacaaatcaatcaagcccggcccacattaacatatccaccttgtatgttattcatctagttagaagagaaattctgtgtacaaaatccgatgtggagcacaccgcttcatcctattgagctacgtagctatcgtttttccatgcatatttaatgcttgcagttttattttttcgtttaaaattttaaataataaaaatatcccttctcttctgaaaaaattatgacattctgtgccgatattatgatatcttgcattgaaattatgactttctacatagaatatcataattttttcacaggatgtcataaagagggaagagcattttcatcattgaaaaatttcatagagtgcatagaaattttttaataacgaaaatatcatttttcctttatgacatcctgtgaaaaaattatgatttttttgcatgtataccttcctaaaaatttaaatttatatgaatatcctttcaaaattgatatttgtatgtataccctcataaaatatttattttgtatgtatattctttttttacatatgtacccacatcatttaatattattaaaaaattaatgatttaaaatttaaatgactaaaatatttttatgaatagatgtgcaacaaaaaaatttataagaatatatatacaaatagtaattttatgaggatattcatataaatttgaatatttagaaggatatacatacaaaaaattctaatttaatttttatctatttcatctagatgtatttagatcctcttactctatcatgtagtaatatattatataatataacaacatgatgacgatattatataatattttatatataaaaatactatattatattttatttttatgcaagatgggatgattatgttcatcttataataatatgatataccttatatactttacaaagatatttttgataaaaatttttaaaataaaatataataaaattataaatttttattattacataatttccaaatccataactatattcattttatgcaaatgtataagctattcatctaatatcatgtttagatattttttttagaagtatattattatacattagaagaaacatggatggttacgatttatttattttttagataaaataattttgatctatcatttgataaaaagatcattttatctatataaattaataaattaagtaaatttattattttagttgtatatgttaatttttttctattaaaataaagaaagaattaacaaaccaaaaaagatatatttatgttaagaattttttgcgtatacacttttaaatattcaaatttgaatgaatatcctcataaaattgttatttacatatatctttataaatttttctttttatacatctatccataaagatattttagtcattttaattttaaaccattaatttttaacggtgttagatgatgtggatacatatgcaaaaaaagatatttcatgaagatatacatgcagatatcaatttaaaaaaaatatttatataaatttaaatatttaaaaaaatatatatatataatttaaaaaattatgatattctatacagaaagacataattccaatacagaatgctataatatcgatacagaatatcataaattttttagaaaaaaaatattttcatcacttaaaattttaaataaaaaaataaaattataaatattaaataaatataaaaaaataatgagtatgtgattcaatcggatgaggcagcgtgcttcacgccggattttctgcaccgcaggcggtgtaccgagaatttcccctcattagacgtacccaaacgggcccgaaagttgattagatgcctgcttctactccgtctttggatttgtcttttgccgcctggtcatttttgacaactcagcaggcctagaatcaagccaaaactttggtggtagaggttttgagggggaaaaaaattactgattgatgcgatttaacatattccatttatggacaatttccaaattgatcaataacccattgtcccgttaggcatgcggcttcaaagaatccacgtcatgccaagacgagggaaatttgtgggaaaggcgaatccaaggaggtcgagaggaaggcgaagaccggtgcggggaagaaaccggagagaaagaccatggatatttaagaaaacaggccggaaaaaaaaaaaaaaaagggtctccggcacctgccaaacattcgctaatgtttcttttaaactttttatttaaaaaaaacttcaattttttttttaaacctgcaccttcccctctttacggaaatataaagatccatgagaaaatgtttcaaagcaaaatatatagaacctttcccccctcaacttacctccactggctgcttttgttgttggactgctctttggctccgagtccggcgatggcgaaacaggagcatctgtcggcggtagccatgctgtagccctggaagggttaaagaaaggaaacaactcataccgaagataacaactgaatccatacaccctggctcctgacctcccattacaacactcgggaataattcccacaaagtcttgaaggcaccggtagcactcgtcatgcggtaggtccctcgtgcactgcaccagaccgtatagcgtgctcgaattcgtatattttgccacgccagtagcaaacatctccgtcgagacattcgctgcggttgtaataagattatccatcatctgacctaacaacttcttgaacagttccggatcagaagcaaggccgccaaccagctcgtaattaaaagaagtatcagcggtggagaagaaattttggtcggagtagcggaggaggcacccttcgtaccaaatggccgagctcatgccatttgggcaccgtttgatgatttctttggtggacgtattgaggcagctcgtgcactcggcaggggatacgtcgcctcggcatagggcaaggccatagacttggtacggcggttggccctcggtatcgttggcgaagccggtggggatggcagcggaggagagggaggagaggaggaggttgagcttggcttggaaggtgctgttggtggtgtagtttgcgtctgtcgttgggcagttattccattggtaattcaataggtagtcacaattggctgagggactatggagtatgaggagaagtgaaaggaggaagagtagtagtaagaacttgggatcgtcggagcaaggcatggtagagaaacgagagaatgggaggaatggccgtccaattatcagagcagttggcagacttttagccttgaatggtagtcaagcacgcctcgacgggacagctggaaggcaagaccggtgtagtcaagcacgcctcgatgggacagctgaaagcaaagacctgtttgacttttggggaaacgtgtcggccaacgcctactgtcagaccggtagtggagaaactgttgcttggaccagggcaaatgtcggagcgtattcacggtgaataacatgcaatcacaaccgggaattggtgaaatccccggggtaatttggcgtgttgtccaccgtgggatttggcgtggtccattggacgtggtccaagtaataattagacagtaaactggtatgacggtccttttactcccagcaaacaggatccggggcctcatctatcttcttggaaccctcgtctcatcattgtcactatttttattaaaaaataaattttaaaatttttaaaataaaaaaatttaacaataaggttggcgacttgaccgataacagtgaagggagaggaaggatggggccagaggtatgattgggaagaagaaagagctccatataagtcaacgagatggttgagggagtggtaaagagagagggagtggggatgcggccggtgacatggctggaaatatgaaatagcttcatgtagaagtgcccgacagggctgggagagcttacatggtcaggcagaggtggcagaattgagtacaagtttggatggaaaaaaaaaaaaaaagattgggaggagagagattaaaatttatttaaaaaattaaaaagatgaaaattttcgcttctattttttaaagaaataataaaaattattttaaaaataaaataaaaatgaaataactaaatatactgccacaaagggattaggatatatgagctccatcgttggacatttatggttggagttaaaagacaggagcccagggtaaaatttttattcttatgatttcatgatgtgtttcccatctatgcatcagaacaaaggaaaaatatttaggctcgtacttactatgcaccagcaatttgttgagtgctttcatgggtttcattcatgtcaaaaaaaactttgcaagaccgaaacctgaaattttacgattcatatctccatctagcaaaatattacttgcttttagatctcgatgaatgatccttagtcgtgactcttcatgaagatagacaagccctcgaccaattcttttgatgatcctgcaccggactcccaattctagttgctctggtctgatgggatctgttgaaacaaagtacgagttggccaatggaaggaccaatgaggccgcaccaacccataaggaaattttgtagcatattcagagctactacaaacatttatgtatcaacaaaaaatgttaaaagctatttgaatgcagagcaatttattaaaaaaaggaaaggatatctccacgagtattaccaagaaccattgggaaataaggttacagagataatatagtaatatttagtataaatcattattatcttaagaaacaagttttcgtagtcagatgtcatgcctgatagatcaaagaaatgaaaattacagactaccctaaagcattcaagagtatactatacgctactgaattgagagcaagaagaacaatatcggcatcctcaaaagctaacaaaattttcaaataacatgttcctaatctggcacatagggctagcgacaaatataaacctactgaaccagcactggttgatatttgcgatagtcacttttaaaaaaaaaaaaatacttttcagcaaaaggtgtttgcgctaatgcttaagatagggtttgctacaaaaagggaaatttaatatggggatgcatttataaaatggagcattaccgcataaaaatttgtcaagaattccattggaagatacccatatgcaagaaggttctcttgctcttataagcaataacccaataactttgcaaggcctctgcgctggacccagcaagcaaccgggccaacctcactgtttagctgttctagtccttgccccgagcttattgagagcctcttcacagctatcacttgtccgtctggtagcattccctttactgcattttaacaatacaattaagtagttaatattttagtcaagttgaatttcgatatttgtacatttctcaaggtaaaaatgccaatttttgagaatcaatattggggttgccttgtaaaatggttcaaatcctccttgtccgattttgttcgcatcagagaagttattcgtcacagctcttaggatttccaaatcaaatattagagactctgcacttctgatctcctttccgtctccatcttctgctcccatttaagatacacacagtccaactttatattcagttgacgcaacatgggttttgagcaaatctaataattcttcaaaacaaatacttgttggttttccagctagtttcgttcgttgtaagtagatgcaaatggtagacggtagcaacaccaccacaattacagttatcactgtaacaacaactattctgattgtgtttccaatatcctgaatcaaaattagagcaaaccagttaaaatcgtattgggagatcgataaacataaatgaagatcctaaaagataaatcatcatgcatatcaacacatttgtagtgttcaatgagtctaacctaacagttgttggcaaaaattggtaatttgctatatcgtatattttttatttgttaaaaataattctctctctatagggataattaaggtgtattttttttttttctcttaacaaggtcccgtttattaacaagtggatctatcctactggatctgtgagaatcagaggaaaccaatcaagcccggcccacattaacaatctagctaattagcgtaactaaacgggcctggaagttgattagatccctgcatctaatcttttccttaaatgaaaaaattcattgcttgacttggctaactcttgtctttggatttgtcttgactcacttggtcattttgacaactcaacaggcctggaatcaagccgaaaccttggaagtgaagaaaaaaggaaagaaagatgatggtggcggaacatattccatgtatatacaaattccaaattgataaataaatcagtatcccgttagacgtaagcttcaatgaatccacgacatgccaacacgagggaaatttgtgggaagggcgacttgaaggaggtcaagaggaaagcgaagaccagtgcggggaagaaaccataaaaactaaaaagacttctaaatggaagattcttgttgccttatgctgggggtgtttaatggtggcttgtgttgaccgcaaatgaattgaaaaaaacacgactatatggattataccaagacaacaaataatgtccaagttcattaaatttatcatattgggacattgttttcaatctcagtcttttaaataaaaatatataactaacgaagtatgatttaagagattcatcatccatgtggtctttgcattaatagtgccctttagttcacgattggagctggaatcaggatcagaatagattcaaatgagaattgaaacggccacatccttcgatatatttgatttataatcggaatcggaattagaatcaaaattaaaatatattcttattccctcttaaaattagaatgggaatagacctcttccagccaaatggctaactcattcccattttcaatctagactccatctcatataaccaaaaaaaaaaaaatctagagtccatctgcttccgatcaacatgccctgagtggcaggtctacctgttttataaaatgaaaaaaagcaacaaaagaaaaatgaaaagaaacacaccaagtcttttgacatcaaaacaagtataaatcatgaatcaagcaacatgataaatatataccggttatattgagattttgcaaatcataatttgatctgcatgcaagctttgacaacgtaaagccgtgtgcttacgatataagcagcgagaaatgtttccaacatatcatttgttaaggagagatgtgcagatcacatacatgatatgatgcacaaaacatagtaggacgtttagcgctatcaatgtgctctagataaatcaatcaaaaaaaaaaggtctatatgctattagatggatcccatatatttatacacccaatttttcgaacataaatagcaggggctgtaccaaatatagtccagataacattaggttgcccatcaaactgtataatgcttggaagacgttactccccatttattacttctcaatggataacaaatcaggttccaagctgccatctataaggttcccacagacttccaatatcatgccattatctggttgatatccagaacataccatatctatcatacaacacagttgatagataaattggtatccgtattgttcacaaaaaatattaacatcaactaatgttcaaagatgcactttgatctatcaatctcacacatctaccgcggctccatctcagtgattgagacatcattcaatgagactagctttgatttccctgtccttctccttgattctcttgttgtgcttccaccggagctctcacctcccgataaactagtcctcacgttcctctcgaacacctctgactctgtgactgtaccactacttacaaagaaggctggtggtgatggaggtggaacagtgacagagtaactactcagcatgagaatgactgatgccatgctgggtctctctcccggttcttcctggacgcagagtagcccaatttgaatgcacctcaatacttctcgggcttgatactgattacctagacttcggtcgatcacctgtgttgccattccttcattccagtgctgccagacctatatattcaaagaattggtttagaggatttcaaaataccaacatgataagaggatactgagagcaagtcagatagctaagaaggtatgaagaatgcttacatagccaagaaggtctatagaattcccagatccctggaatccactattcctccggccagtcacaatctccaaaactagcacgccataactgaaaacatctgatttggtggagaagtgtccatgcatggcatattctggtgccatatacccactaccataaagaaattgagaagatatttctccatgaggacaacatacttatattgattcaaagtcagatttcagaacaataatggactggacatctttccactggttattcagaaaaggaaattaaaatcgcatgcacttactatgttccggcaattcgactagtgtttccatgggtctcatctctgctgaaaagctttgcaagaccgaagtccgaaattttagggttcatgtccccatccagcaagatattacctggttttagatcccgatgaataatccttaatcgagaatccacatgaagatagagaagcccgcggcccatcccttcaattatcttgtatcggcttccccagtcgagttgttgtcgtccaatagggtctatttcatccaaataaacttgataaattaaactgatatcataatgaataacaagcacggttgggccatgccatcaacaagatgttagcaaccccaagtagttaaatcaagggtggcctagcctccactaagtcggaagagtaaaaagcagttatatcataaacattttcccaaaaatagcatggaagacaattaaaacccagtagcatgcaaaaatgatgccatcattaattgatagagtcatcttcataaatgagcgccctagaagaaatcaggcaatgcaaaatgatggcattcgcatctatccatgttgcaataatcttaacagctgaaacagaaatcccagggtaccaaagtatgttcaaggtaatgcaaagttaaattagatggaacaaagactataaagtaacaccttaaagaggaataacatgtatccagtgttgtaagaggctagaacaaatatatccagcttagttcggtgaatggctcaccacaacagggttacacacgtaacaaacctgatcatgtgttcctatttgcttaaaaccagggaagtactatggcaatgattatgaaaaatatgaatatagaaaatggagcataccgaataaaaatttgtcaaggcttgtatttggaaggtactcatagacaagtaacctctcttgttcctcgaggcaacaacccaacaacttcacaaggtttctatgttgaagcttggcaaccaaaaccagctcatttcttagctctactagtccttgcactgaacttcctgagagccttttcacagctatttctcgtccatcccgcagagtcccctgtatgagatttaaaagacacaagaaagcaattcccattcttcaaataaataacgatgtttacaattttatgagtgaccttgaagacctgactctagataattaccttgtaaactggtccgaacccaccttctccaagcttatttgcatttgagaagttatttgtggcagctctaagggcacccaaatcaaataataatgattctgaacttctgaacccttcctcatctccaccagttacggacagagcaatctcaactacataaaaatccagcccatttgtcatgaattggatttcctaaaacaatagtgcagcaagaaaaacttacattgttctcttctaaacactttccttcttcgtaagcacaaacagatggcgaaaaggaccaccagtacagcaacgacagagatggcaacaattagaactacttttgtagtgttgttacttttccctgcaccaaaagaaaagctagcaattagacaatgtcatttgggaacgaagatataaacaagacccaattaaactgcaaatcgccgaccatacactctaaagaccaaaaacttaaattacttattgcttagacacgacctattttccttctaagaaatcgaaaccagcaataaataacttttttccaaagtttataaaccaaggtggactcttataaccttgaagtgaagttctatgacataactctagcagtcaagttgcctacaattagtacatttgacagtgaaatgagaatagcatttattctgctgcatgtttccaaagcagcagtaaacatggggtttgagttgtatctaccgcaaaagaagattgatcttccttccgttggattgcgtctatacacatcccaaagcaatcggaatctctcgttcatccgtttgcgtacgtctcaaatggatgattgcatgatccaacgatggaattgtgcttaaaaaaagatgaacccttttaccatcgtgctaaatagagatgacaacgagttatggaccggatgagccgttacctatatccatcctgtatgagttttggatgggacaggatggacaaagttaaataagatgagttggattggataaaattataaaaataatttttaatatatatatatatatatatcaagatctgaattagagcaaatcttatcattatctacatctatccagatccatcgtgggctaagttaaatccaccgcattggaaatgggtccgaccagattctcgatagtgcagagtaaattgtcatctctagcactaaagatacaaccctgtccggcacataatgttcctcccggacacacacacacccaaaaaaaaaatcacagcagcataggccaccatcatgctttgtggtccgaaggttattaaaactaaatttattggtattccagaaacaaaataagtttcatcagggaaaaaagaaaagcaaaaacaaaaacgaaagttccgaatacggttcaactgctgaaaaaatcgttgagtcttgattatctctatcaaactatggaattcatcgtctcaagtcgattgaaagcgcacatagttctaaagactaaattactatatggaactcatgacaaaggagtagaaaactgaagatgtgaattcgttgttaaagccagccaaattaacaggataacaaataaagccccagaaactgcaattttattttggtgctctatccttatcggagtaactagccgtatcgtcgaaattaacaactactcaacacaatatccaccaaactcggcgatctgttaacctaaatcatacctgagggaggcattctacatcaagtggtgaactttgcttaccatcagcggtcgtgtcagtgccattcccaccgtccagcgaagaactcgatccctgcggcggcggcggcggcggcggcggcggcggcggagggaccaacgacagggagaaaaagggatagatctcaaatctaacggcacaactcaccttcacgacctgtcctccgatactcccggtaggcaaaagaccgaccgcctgatcgagacacgtggagcaatccgtctccgatagatcacgagtacactgtgccatcccgtatatatccccagaatcggtgttattcgtgatccccaccccaaacttcgactccctccccgccgcttgcgacgcgatctcgtccatcagatccctcatctcccgatcgaacaccgttggatcagacgcgttagcgccattgacaagcatctgggtcggttcgtcttcgagctggccaaagaagcgttggtcggagtaacggaggatgcagaggtcgaagcggattgcggccgacttgcgatgggggcagcgggtggcggcggcggaggcggagcggttgaggcaggtggaacacttgaaggcggaggcgtcgggtcggcactgggcgagtccgtaggtgggtgcggaggaggcggcgccggcggtggcggtggcgaagtagccggcgtcgctgggagaagaggtgaggttggagaggaggaggtcgaggttggaggagaaggtgctggggacggtgtaattggtgtcgccggcgcaataggtgaggatggggtcattctgggaataagttttggtcggagctagaagcagagcatggaggattagcaaagggaatagagacaagatggattgcatgatgggatgttctgggaagaggagggatagactgggaatggggactttgcctgcaaactttctgctttgggacgcgggtagagagcaccgaggaggaagaacagcaccgatttgacgggagagggggcaggtacttttcttgacatctcttttgactactgggatcttctgttgttgggtgttttgcctaaataattttaaaaaataatttatttataaaaataatctaatttttaatttatttattaaaataatataaatcagataaaatatcattcaaaatgatcgtcacatcatcattttttttatattttttttatatagattataaaaaaaataaaataaaataaaatcatcattttcaatgatattttttaaaacgtcatttgaaataatatttttaaaaataccatttcaagtgacaaatttaattattaattttttttaaaaaataaaaaaataaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgatgtgaaacccaatggaaaacttttttccattatttcactctgccatggccatgggcttaaggacttgatctttcaatcatcataggactactcctctcatctatcaagattgatagatcccatcttggttcgatctagttcctacaatgaatatgctacaaccaacatacacctcaggattctaaatggctaggagaccgagttatgatgtagtcaaactataacacactcaaggtgaaccgtcgatgcacatcaggtcaaagaactagacacacaactgtagtatcgagctagtcatcgacgagaaagtagacttccttatgactgcttgaggtggtcacgctcagtactcttgttctcaatgaatatttatactctcgctctggtatctccacaccgtagactcaagactcatctaccctaagaaagtgatcgtacaccaaccttccggatcgatcaccatccttatgatgatcctatggtcaggagcagtttatgagttagttatgtaaattcatgccttaaattttcaactcttgaaaatatgaatttacattctcactaactcaaagaatgtatcacagacataatgtacacaatatgatagaagaataatccttttattcatttataatcaaaattataaatttgtccttagatttgtacaggcatgtgtcagccgatctggcatctaggacacacatctaacaggacattggtcttattactgctttgcttgagagatggcatccagagacacacatgttttatcttccatttggtgaggcgaccattactttacaggatgtcagcatccttactggactaccagttgatggcgattcagttaccagagttgatctcacgcttatcattccggagtggcaggctttgtgcttgcgattgctagggtttgagcctgacgcctaatttttcgatcattcacgactcaggattgagtgtttggatgatcgatatcgatattttcatattgaggatgatgcaccagaggagatggtgcagcaatatgttaggagtcaggtgctgtggttgttaggtggtgtcctgttacccgattcttcatcgaataagataaagttgatattttttctattattagaggatttagacttcgctcgtagactcagttgggataatgcagtactagcttgcctgtacagagctatgtgtcacggttcttatgctgatcagagcgagattggtggttatcttgtattattacaggtatataaattaaaaaaattatttttaatattcaattatagttcacattgggtatatcatgtatgattattttaaaatttgtagatttgggtatggaagcgtatgctgactatcagtccattacgacgatagttactcgagatgctatcagagcaacatgatcctgatgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacttgaaacttactgttttaaatctgataaaatttatttaacttgagtagattgtgaaacagatggaatgttgcattcaacgttcatcacgtatcgacgagagtggcacggatttataggtgccagttggatacattacttaatacatatagacggataaatttaatttttttataaatattattttacagtattcataatctattaaaattttagcttgctaattttttttattttaactctatcaatttttgtgggagccatatacagatgagatattggctatattgccgcagatgtgtacagttggacatgacatatggactgctaggatgccacttatttattttgatgtggtagagtgacatcttttcgatcatgtcctatggcagtttggtcagattcaaggcatcctaaagcagtttgataccagctagggacttcatcgtattgattgatgagggagagctcttgtattgactggcgtatcagacatgcagagtacatcgatatttaggatgcacgtcgagatcatattgttcatggtgatcccattttgagaggtcgttcatataccgatgactacatggcttgattttttagcattacagtgtgagtcattggacaacctcggtatgcagttcccggatatgagggtgagagttctgctgtgcgtcttttggtaagactacgaaaattagtttatgttatttatgttatatttttattttatattttacagtatattgactgttttatttttattatgtagactgattatatgtcggatcttgtattggatgctcatcgtactttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttttttatttttttttatttttatttttttagagaattaataattaaactcgtcacttgaaatgacgtttttaaaaatatcatttcaaatggcgttttaaaaaatataatttgaaacgataattttaattttttctttttcatcgttcatgtgaaaaaagatgaaaaaaaaggtaatgacgtggtcatcataaaacatcattttggatgatgttttataagatttatattattttgataaataaattaaaaattaaattatttttataaatatttttttttaaattatttaagtaaagcactcttccgttggttctgctacgagacttcggggaacgtggacaaattggttttggattggctacgccaactgtcgtgatacaagtctgtgcatgcggagaaggtaggcgctgactgtcctgctgcatgcattgtgtgtgatgtccgtggagagagacgagtgcgagcacgtgcttgaagaaaatctgggattgaaggaattcatcggcttgacttcagcttttttcttattttccatgatcttgttttcttcgaaaagaatcaagggcagcggaattgatagatccgatggaactatgattgaaatcccagcaggagtagattagcttggtctcgaagcccgcaacctttttaacaaaagcacagctaaccacagcaaaagcatacattatgtcagttgggataccgtacggaaataaaaatcatatggggcagacaccgtagaatatcatataaggcggcttttctaatttattatattttctaatattaattttaaaatataaatctaaaaaataattttttttctactaacaaaatttttagtttcataattaataaattataatttttttttcatttttaatatatctattttatcaatacatactgcatgatcatataatatacattaaaattaattatcaaacaagttaatatacacttttaaataaatcaatatatagttttcaaaatatagaattcatcaatatatagtatatgattagatgatacatacttagtaaattagttttttaatgatccaatatacacctccaaacaaattgatacattgtttctggaacattattgtcatcagtatacactatatatctaagtacagttatcgtgtgatacagtccttctatcatgggttccgactagtcggaggtcaaaaaatactcatcaaatctcatcgtcagtcatatgtcaaatttattcaactcgagttcatcctgtgatttttcgtagaaactcctttctactaatcacatgacttggccaaggatttctgaactcaatctcataaatcgcatcggactactccttatctatcaagatcaatagattctatgtagatacaatctactactatagtgaacctactgcagtcaacatgtattgcaaagatccaaatgactaaggatcaaatgtatgtacagtcaaactatagccgaggcactacaggtcaaggaccaatcacaccactgcagcatcaagcaagtcactgacgagtgagtaaacatccaagtgatttctcgtgtggtcatgcttagtaccattgttctccaacaaccatctgcactctcgtccagtatccctacactataaacttaagactcatctatccagaaggaagtgatccgtgcaccaacctcatcggatcatccaccgtctctgtgatgatccatctattggaagcaatttagaaattaaccatcaatgatatatatttcaaattcttaactcttgagaatatatgtcaccatctgttaatcttttggacaattcatggacaataaaacataaacatgaatgaaaaactagcctaatattattaatttaataagtcaaaattacaaactatatccttagagtatttacaagtgtcagtcaacttgacttctaggatatacatctaacaatatagtttggtgacacatactcatcgatttttttgatatatattataagcttatttgatatatattcaacggtaatccaatacgtatctgtaggtaaatcaatacagtttctaggtgtgtattgaagaagcttgtagtatgtatcagaatatcgatcagtatgtatcaccatatcatataatatatattgataaatataatattttaaaaaatatatattaatttatttagaggtgtatattagtttgctagatgattaatttactaagtatgtcttatatggccatcactatatattgatgaattttatattctagaaactgtgtattaatttatctatcagtatgattggattactattatgtgtgtaccaaagaaacttacagtatatatcaagaagttgatgggtgtgtatcactataatatatagtatataatattctgaaaaagtatatcaatttacttatagatgtgtattgaattattagatgactaatttgttaagtatatatcatttggttttatactatgtattgataaactccatattccaaaaattatatattgatttctctgaaggtgtgtattgacttatttaatgattaatttacttggtatatatcatttgactatatagtatgtactgatgaaaaatatattatgaaaacacgagagaaagagaataccatacttttattttgaattactagattaatgactcccttagtagaagaaaccttttaattacttttaagtttcttttttaagattagtattaaaagaaatatgacaaaattaaaaatctaccccataattttttttctagtacccgtcccatatgatttttgttctaccatatgaatactgaaggctcataactaccaaggtggttttagtaaccatgcatgcgatggtggttctgcaggggcaccataagccttaggtctgatttatgtcatggaaatacgagccttgggaccctgggatgataggccttttcaaaagggctgaaatcagatcgaatatggatcagataccaatatatctatatccatatttattttatctaacaaatataaaaatggatatagatattattcagatgaaaaattaatattcatatttatttaaaatggatatggatacaatttggatactgaaaatatggatataattatggatataaattggacaattaaacttgatgactatagaatcaaatatattactaaatagatgataaattaagttaatagtgtatttatatatttataatttctcttaaaaattagtaaatactatataaaataatatagagttacatatagattcggatacggatcaaatgactgtctatttatatctatatctattttttttgataaatatagatacgaatacagatattagttgaatttttaaatttctatccatatccaaattgatttagatatgaaaataaatccagacagatattatccataccattttaacccctactcttcagagtggagaaattattacacgcattaggtccaagtgaactagggtaaatctcgaaacatatatgcatagtggctagcacgcaatcaaaaattagtgaaatacaaggggtaacatggcatgttatccaccgtgggatttggcgcagtcgaattgcacatggtgcatgcaatatttagaccttcagggtgtatatcttcaacagaaatggagggatgctagatgggtttggaaggcatatgttcacgagggagctgctgtttgtttggaaattggtatggaaccatttgccccataaatgtaacgccatcggatggggatccatatttctttccattgtcaacaatgtatagcggtggaaaaaaccattggccatgtgctttttctatttttggtaagaagaccatgtgctttttaagtgccctaaatgcagatttcgagtcagacattctgctgcttatctatttccttccatccatggaatttagaggcctttcttcaactaattaaggggtccaaccatagaaaagatggaaaccaagggccagctacattatactatcttgtttatcaaatctagttagctagaaataaacatctctttcatgatactaatcagtgctcgctagttattatcttaagggcttgttcttttatggataaatattatgaaaaagttgattaactttctcattgaccaacttatcaatattctcacagttttcaaaatggataagttacttttcatgagtagcatttacccataaaatgaagaaaaatcttacccacctaagaggtggccaaatcatttttccatcaatcgaaaaaataatccatttaatttatttctaatatacctttaaccatataataatataatataatataatataatatttatataatatattataatagtataataataatgtaataatataatatattatactatattattctaccatgttattatataataatatattactatacattataacaatatgaatttcagggtggatggtttggagggtttctcttcttttcttctttttgtactcactttcttcttaataaattatggttactattgtgttaaagcatattagtctcctttatatcaaaaaaacaaaaaaaaatcttcctcctagatcttcctagatgcacggtagcccaacgtgaatgcatctcaatacttcttgcaatgtataccgatcacccagacttcgattcatcatctgcaacaccaccacttcattccaacgttgccaaacctattttacaaatatgtttggaggaactattagttattgcagagattgcaattaatgcaattgatattggtgatagtcaatcaacttatgaccagatgaatgcttacatggcttagaaggtctgcagcttgcccagatccctagaaaccattagccctccgaccagtcaagatatccaaaactagcaccacatagctgaaaacgtctgatttagtggagaagtgcccatgcttatcatattcaggagccatatatatatccattacgataaagaatttgaccacattagattttctgtgtgagcagatactgatgattcaggtcaaagatcagaataataattggctggattttttttcccactaattaggagaaggcattgatgcagtcgtgcttaccgtgtccctgcaattcggcttgtgtttcctttggaatggagacattgtttccaaactttctgattctggacgtggctgaagagcacggaggagaagaaaacagcggatttgatgggagtggcggtgggctggtggcggatttgacgggaattggggctacattcgctgagatcactttgagggcatctgatttgctgatagcgccactttgaacacagaaattaagcaggcgctgaagggcttggaagaggaacagagttaccacggagcatgagaacgactgaagccaagctgggtctctttgctggatctgcttggatgcatggaagcccaatgtgaatgcatcccggtacttcttgcaattggcaccgatcacagagactttgttcggtcacatgtgatgccattccttcattccattgttgccgcaaaccgccaataattgctttaaaggagtcatataacacttgtattgccaatggaattagaggatccctctaaatataatgtacattagattattaataatcaagctctacaacgaggattcctctgtccctttggacttctgtaaatattgcatctcaataaattagtaggtggccttttttccagcctcctaaatcctaatccattcaaaaaaaaaaaagaatgacgaatgcttacgtggcttggaagatccattgcatgccctgatcctacaaaatcactattcctttgaccagtcactatctctaaaactaatatactgtaactaaatacatctgacttgctggaaaagtgcccatgcttaacgtcttcctgtgccatgtcgccactgccacaaaggaaatacagcgtttgagctccattgttggacacacatgatggaagttaaagacaggagtgctggataaacttttttttttatgatttcatgatgtgtttcccatctttgcatcagaacaaagaaaaaatatttaggctcgtactttgcaccagcaatttgttgagtgctttcatgggtttcatccacgtcaaaaaaaactttgcaagaccgaaacctgaaattttaggattcatatctccatctagcaaaatattacttgcttttagatctcgatgaatgatccttagtcgtgaacttgcatgaagatagacaagccctcgaccaattcttttgatgatcctgcaccgaactcccaattctagttgctctcgtctgatgggatctgttgaaacaaagtacaagttgcccaatggaaggaccaaggaggccgcaccaattcataaggaaattttgcagcatatttagagctactataaacatttatgtatcaacaaaaaatggtaaaagctatttgaatgcagagcaattcattaataaaaggaaaggatatctccacgagtattaccaagaactattgggaaataaggttacagaggtaatatagtaatatttagtataaatcattattaccttaagaaacaagatttcgtagtcaaatgtcatgcctgatagatcaaagaaataaaaatcacaggctaccctaaagcattcaagagtatacgctagggttgaaaacggatcgaatatggattggatatcaccatatccatattcgtgattattttatccgatgaatataaatacggatatgaatattattcaaatgcaaaaatttatatccatatttgttttaaatggatacgaatacaattcagatactaaaaatatggatataattatggatattacttagacaattaaagtttatgactaccgaatcaaagatattactaaataaataataaatcaagttaataatatatttatatgattatataatttttttaaaattattaattattatattaaattatataggattatatatagattcagatattcggatacagatcggatagttgtctatctatattcatattcatttttctttaatagatatgaaaacagatatggatattagttggatccttaaatttctgtcattgattcggatattaaatggatccgaacggataatatccatactattttcacccctaatatatgctactcaattgagagcaagaagaacaatatcggcatcctcaaaagctaacaaaattttcaaataacatgtacctaatctggcatatagggctagcgacaaatataaacccactagttgatatttgatatttgcggtagtcatttttcaacaaaaaaaaaaaatcttttcagcaaaaggtgtttgcttaacatagggtttgccacaaaaagggaaatttaatatggggatgcacttataaaatggagcataccgcataaaaatatgtcaagaattccattggaagatactcatatgcaagaaggttctcttgctcttataagcaataacccaacaactttgcaaggtccctgcgctggacccaggtagtaaccaggaccgggccaaactcactgtttagctgttctagtccgtgccccgagcttattgagagcctcttcacggctatcacttgcccatctggtagtattccctttattgcattttaacaatacaattaaggagttaatattttagtcaagttgaattttgatatttgtacatttctcaaggtaaaaatgccaatttttgagaatcaatcttggggttaccttgtaaaatggtccaaatcctcgtctgattttgtttgcatcaaagaagttatttgtcacagctcttaggatttccaaatcaaatattagagactctgcacttttgatctcctttctatctccatcttctgctcccatttaagatgcatagagtcaaactctacatccaactgacgcaacgtgagttttgggcaaaaaaatctaataattcttcaaaacacatacatgttggttttctagctagtttcgtttgttgtaagtacgtgccagcggtagacgatggtaacaccaccacaactacagttatcactataacaacaagtattttgattgtgtttccaatatttcctgaatcaaaattagaacaaaccagttaaaattatattgggagatcgataaacataaatgaagagcctgaaagataaattatcatgcatatccacacatttgtaatgttcaataagtctaacctaacagattgttggcaaaaatcggtaattttctatatcttatattttttatttgttaaaaataattctcggtctatagggataattaaggcgtattttttctcttaacaacttgccgtttatgaacaagtggatctatcctactggatgtatgagaatcagagcaaaccggccacattaaccaatctagcttagcattcccaaacgggcctggaagttgattagatccctgcgtctaatcttttccttaaatgaaaaatgcattacttgacttggctcactctgtctttggatttgtctttcctcacttggtcattttgacaactcaacaggcctggaatcaagccgaaacttcggaaattgaaagtgatgaaaaaaagagagagatgatggtgacggaaaatattccatttatatataaaaattccaaattgataaataactcagtatcccgttagacgtggagcttcaatgaatccacgtcatgccaagacgagcgatatttgtgggaagggcgaattggaggaggtcaagaggaaagcggagaccggtgcggggtagaaaccttgaaattaaaaactaaaaagacttccaaatggaagacgcttgttgccttatgctgggggcgtttaatggtggcctgtgttgaccgcaaatgaagtgataaaaacaaactatatggattataccaagataacaaataatgctcaagttcattaaatttattatattaggatattggcttcgatcacagtcttttaaatgaaaataaataattaacaaagtatgatttaagagattcatcatccatgtggtctttacattaatagtgctttttggtcaatgaacggaaccaaaatcaaaatcggaatagatccaaatgggaattgaaatgattatatcctctcatatatttgatttatgatcagaatcaaaattggaatcaaaattggggcatattccgatacctttttaaaattgaaatgggaatggaccactcctaaccaaatggttcactcattctcattctcaatctagagtccatctacctccaatcaaacatgtcttggatggcaggtctgcttgttttatgaaatgaaaaaagaaataaaagaaaaaatgaaaagaaacataccaagtcttttgacatcaaaacaagtataaatcatgaatcaagcaacataataaatctaccctagttatattttgattttgcaaattataatttgacctgtatgcaagttttgacaacataaagctgtgtgtctacaatttttttttttttttttttgagtaaccaggaggaaagggtgatttccctgtgatatatattagatagataatatggtatttacagtgtctatatttacagtgatatatatatatgatattttgaggagttggtggcaatgtaccaatagattgagcggtggatgtaatggtcaaggattatgattatacataaaaaaataatggcagcagagagaggtgatctcgaactaaaatttcataatctggaggcagtgtgagtatcctgtttgctatatttgcacccatcagtaaagagtgtcgaattgttgagcgaacttcagtcctgcaactttattgacctatccggcttgaggacaaaggaagatcttcactagaattaaccgatatattagtgctttcttcgttgcttgcaagatggctgaggaaagcttcatcatatgaaatctctgcatggggattttgattccatcttcctccaaattgtaacgtgtctagtcagcgaagagatgagctatttttcttactatttttgatttcgactatgcttcaaagcgggagatcctgctatttcgttccttccaaaccaacattgagtagtgagaagaagtgatgcaaatgccttatcctgttccttttgtagatctaaataaatccactccgtccaaatttgagggatatgcttaggtaggggaggaacactggtaaatcttgtaagtgttgaccaagaggtggtgaaatatgaacattgcaacagtaaatgttcagtggtttcatcttctctataacatagtatgcattacttttcaacttgcacacctttttttagcagattttccatggttagaattttgttctgataaattaaccaaccaaaaattttcacctttttgggcaatgttaatttccatagtattttagctaggatatgttgaacaccaccatcaatcagaaagtggtaacagtttctgactgaaaatctaccattgttgctccatctccaaattcttcaatccggtttctctgttaatgatctatccggcaagatttttgtgagtttcggaaagtcggaaagtcgtcggatgctgcataacttagtggtcttccgaagtaaaccttctagtcatggcttgaaatgaattgagcaatgctgatatttttgttgaaagcaaatgcatgtagtttagggagggtgaagtcaagagcttctcctcttatccagatgtcataccagaaagacgtggacgttcttttaccaacatttgagatggtgaaagcccgaaatagtcatgcaagtttagtgacttccttccagaggggtgatgttccatcagaaatgttttcataagcaagcggaggcaaagaagatcagtaatatatcctaaaaattatttgtgaccatgatttattggggtttgtaaaaagattccaccaccattttaacaacaatgaaatgttcatgagttcgatgttgcggattctcaatcctcctatgttcttagatctgcaaactgttgcccaacttatcaagttcttgattttttcatgttgctaattttcactccatataaatctatggcagcaggtattgattttgttaataactgattctgatagcatgaacaccgatatccggtacactgggatggcattaagaacagaacaaactaaagtttggcgtttggccaatgacagggtgtttttttttccatcttgctagttttttgtctaatttatccaagataaatgaccaatcccttgctttcaaataggagctatgcaacgatattcttaggtaatcaattggcagctgagcaacacgctataagaaatttaattttttacaatgaaattttttcattgctaaagataaaatttttgtcgctaaaagtattagcaacaaaaattttcatcgctaaaggtttgtagagaaagcctcgtagcaaaaaggccttggtgacgaaaaaattttattttatcatcaaaaatagtcaatctgacaacggaagagttcgcagtattagcgatgaaaaagtttatcgcaagagcttaaaatttcatcattaaaattatgatgaaaaatattttcatcgtaaaaaatcagttgttactcatttaaattttttattatttttttaattttagcgatgaaaaatagaatttcatcgtaaaaattagtgatgaaaaaaaatttcatcgctaactatcatgactaaataaaaaattttctcacaatttttgcaatgagagaaaattttatcataatttttgtgatgaaaaaaattttcatcataatttttgcgatgaaaaaaatttcatcataatttttgcaatgaaaaaaaaatttatcataatttttgtgataaaaaaaaattgttgcaatttttacgatgaaacaaaaatttgtcataatttttgtgatgaaaaaaaaatttcatcataattttttgtgatgaaaaaaatttatcataatttttgcgattaaaaaaaaatttgtcataatttttgcgatgaaataaaaatttcattgtaatttttgtgatgaaaataaaaatttcatcactatttttgcgatgaaaaaaatttcatcactaaaaaaaataaagaaaaaaataaaatttatgataaaaaatatttttagcgatgaaaattattttcatcataattttagcaaaaaaaatatttcatcgcaatatatagtaaaaatttgattttttacgatcattaaaattttttaattattttttatgataaaattaatatttcattgctaaattaaattatggataaaataaaatattttttattttttatcaaaaaaataactatttaaatgtaaattttcatgtcaaacatattttagataaaaatatattaacacaataaaaatattcaaattcgaaataataattctaaatagcaataagtttcatagccatcattgtcatatacaaaaatacaagttcatacaccatttaaaatttaaaaaactacaaactatgtatcatcagagtcattggcctcgttctctcctccaagcgtcgatctttagctcgatatgtgtcgcgatggtggtatagaggcggcatcatgcgactgtagaggtgctaacttggaggcatcgataccgagccatttcaccatcgcagccactatcctctcgagtgtctgattacgattcatccagtaagtaatttgatcctacatcatgctcatcaatatcttaacgacctctggcaccgatgcatcatcagactagctggataacaaactgcgagatttttttgatcgcatgctatgcccagatcctaactgccgtccgaggaaggcatccatgatcgcatcatctatcattgaacaaacctgctgcaatccaagtatccttgcataagttttcaggatgtcattttgctggcttaaaccaatgatattggacttagcaaagttaactttcaagcctgtcaataattcaaagttatataggatgattttgatagtattaatgtccctttttttgatgagctgaagaggatggtatcatcagtgtactgtaagcaagtgagtggttcgttaaaattagaaggatcaaggccattaatcatctagttagctaccactaacttaagcatcttgtttaggacatcagcgaccaaaataaatagtaaaggagagaggattatcctgctttagtctttttggcttcgaaaagacctttccttaactctatttataattactgaggacatatttgtttggatgatcgatgacacccattgtctccaatgaattccaaatcctcttttctccatcagctgattaagaaagaaccaggagatgttgtcaaaagctttttcaaagtcaattttgcacatgatacctttctgcttgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgtgctggagaggaagaggaggagcaaaggacattattacctgatggaaagcccagtgcgaggtggagcttcggaagccaggaggagcctagagcgagatggagctccaggtggaggtggatcgggcacaagacaggagactcggaaggacgagaggtgacgtcgcaaagtgagattcctattgccgcaggatgatgccccgagtagatctcagatcaagaggagcacagtatacgatggagatgggatcgagcggcttgactcgactcacatgtttgcccatccatgatcagcaggcgattgcctcaggacatgggagcgaggagatccagaagctctcgaagttaggaggagatcgaatatcgagtcgagatagagattgttaggatttgacatctcaagattcagtccacattgagcccacagcgaggtccgcgatgaaaaatggagtccaacgagactaagatcaccccaaacggagcttggatggagaagatacgaacttttgaagtcagcacgagacccgagatggtggaggaccgtcggcgatcggtggtgggccggaggaacggcggcggcgcggtcgcaggtggcggagtacggcccaggcggggccaatgcatcgagtgcgcggcccaggtgcgtggcccagcccacgtgcgggccgcagggcacggctcgggcccaggcgcccgatgcaggcgctgcccaggcccgcacgcgcgggccggcccaggcccaggcactgcacctgggcctgtacccagtccacgttggatcgggcggtccacgggcgggtctgtggaccgcctgggcatttcccaggcatttctcgcggtccacggtactattccatggatcgatcttgatcagacggcccaggaatgtccctgtcatgatccgacggttggggaaggattttgggcctgtttaggagacctaaattaggtttaagccctttaaatagggcctgggaatagtgaacaggagatatgtgtggcctggtttctcgcggatgcgggcgtgaaagctttgcacagaaaatgaagatcagaacccaaaagagaagagtgagagccgtacgttgggaaaggagcagagctcctggactgcggatgccgatcacttcaggggttcaggaggatttttcaagagagagagaacttttgtgaggaaaacttctggtgagagaaaaattgggtgtacgagggttgaggatgagatctcctcttgtaaaatttttttttataataaaatttatatgtctcgtggaggcgagcttttttgtggctgatccatgtattttgattattttttattttatttattttttcttcctgctgtatcgcatggtactgaaaaagtcttgagagatagtgtcttggccagacatccacccaacattataggcttgaaagaggtggttgagaggtctaaatccttatcagagagtagggatgagctatcaccaatagtttgggactcagagtcttagtgccgccggcgatcatcggcaccaggtgcatcctttacagaagaggcggatccaggttgctggagatagagcttactaggagagccgaaccaaaagttgcgttcgctctcgtcaaggtcgtcgaagtcttcatagttggaggatgctccatcaaacggcgggaattcaagccttgcgaacttgatagtaactcgaaccacatacattcgaggaccgatcgtgacatgaacgtactcaggaacagctgtgggatcctcacggtaaaactggatgtcgaaacttgtaatatcgtcccattgaaggcttgatctgctggcccagaaagggtatccaaaactgaaaataatagtagttgcagactcggcattctagcacatcaaaggaaggtcatggagagaggcacccaccttgtagcgaagattatgagtcctggctcctctgtgttgatcctaggggctgaccacaagcgagaaaccttccctgccgatatggctcatggacatgagggtgtggatgacgtccctagaaggacatgagacaaagaagtggttttcctcctctaattgcttggaccaagatcccgacaccttggcgtcctgggcgagggtggcagcaaagtcactgaccttaatttttctgccaaaagattcaactaaagcgactctctctagatggttagaaatctctgtcatctcagcggtgattggtaggaagcatttagcaattcggtggatctgtggttccggattgattggttgtggagggagggggggggggggggtgtgaatggttgtaatggagataagtgatttatgggagaggaagagagcgaggagttatgggtgactggccgatgaaccgggacgaggggatgcactgaagctttgcaggttttataggcatggccgaaacctttgcggcaaaaacatttaatcgggtttctacactctcttccagtgacttctctccccacatcggaaacagacgtcgattcgaaaaggtttggtaggagcagagttaatacccgaagcagcacggtgtaaatgagtcatggagtagttagtggacgatgatggccggtcggcacggaacggagcatctcgtgtgcctacaatataagcagccagaaatttttccaacacgtcattttttaaggagagatgcagatcacatatatgacatggtgcacataacatactaggacgtttagccctatcaatgtggtccagattaaaaataaaaaaaaaagagaaaacatggtctatatggtattagctggatcccatatatttatacgccctatttttcgaacataaagagcaggggctttatccaaatatagtccagagagcattaggttgcccatcaaattgtacaatgcttggaagacattactcctcatttattactccttaatggataacaaatcaggttccaagctgccatcaataaagttcccacagacttccaatatcatgccattatctggatgatatccagagcataccacatctatacagcacagttgatagagaaattgatgtccgtattgttcataaaaaaatattaacatcaactaatgttcaaagatgcacttcctatctatcaatctcacacatctatcgcggctccatctccgtgatcgagacatcattcaatgagactagctttgattttcctgtccttggttctcttgttgtgcttccactggagctcccacctcccgataaactagtcctcactgtaccagtaccactactcataaggaaggctggtggcgatggaggtggaacagtgacagaggaactgctgagcatgagaatgaccgatgccatgctgggtctctctgccggctcttcctggacgcagagtagcccgatgtgaatgcacctcaatacttctcgggcttcatactgattacctagaatttggtcgatcacctgtgttgccattccttcagtccagtgctgccagacctatatattcaaagaatcagtttagaggatttcaaaatgctaacatgataaaaggatactgagaacagtagatcaacctatgtctgtgtgtgtgtgtgtgtgtgtgtgtgtcgggtggctaagaagctctgaggaatgctcacatagccaagaaggtctaaagaattcccggatcccttgaatccactattcctccggccagtcacaatctccaaaactaggacgccataactgaaaacatctgatttggtggagaagtgcccatgcaaggcatattctggtgccatatacccactgccataaagaaaatgggaagatattagatttttctccatgaggacatccttatattgattcaagtcagatttcagaacaataatggactggacatctttccactggttattcagaaaaggaaattaaaaacgtatgcacttactatgttccagcaattcgactagtgtttccatgggtctcatctctgccaaaaagctttgcaagaccgaagtctgaaattttagggttcatgtccccatccagcaagatattacctgcttttagatcccgatgaataatccttaatcgagaatcctcatgaagatagagaagcccgcggcccatcccttcaattatcttgtatcggcttccccagtctagttgttgtcgtccaatagggtctatttcattagagtaaacttgccaaattaaactgagatcataatgaataacaagtacggttgggccatgccatcaacaagatgttagcaaacccaagtagttaaatcaagggtggcctagcctccactaaatcggaagagtaaaaagcagttatatcataaacaattacccaaaaatagcatggaagacagttaaaacccggtagcatgcaaaaatgatgccatcattgatagagtcatcttaataaatggtcgcactggaagaaatcaggctacgcaaaatgatggcattcgcatcaatccatatcgcaagaatcttagtatgcaaagccagataacagctgaaaaagaaaatccggagtatgttcaaggtaatgctaagttaaattagattgaacaaagactataaagtaaccttaaagaggaataacatgtatcaagtgttgtaagaggctagaacaaatatatccagcgtagttcggtgaatggctcaccacaacagggttacacgcgtaacaaacctgatgatgtgttcgtatttgcttaaaaccagggaagtactatggcattgattatgaaaaatatgaatatagaaaatggagcataccgtataaaaatttgtcaaggcttgaatttggaaggtactcatagacaagtaacctctcttgttcctcaatgcaacaacccaacaacttcacaaggtttctatgttgaagcttggcaaccaaaaccagctcatttcttagctccaccagtccttgcgctgaacttcccaagagccttttcacagctatttctcgtccatccagcagagtcccctgtatgagatttaaaagacacaagaaagcaattctcattcatcaaataaataacgatgtttacaatttatgagtgaccttgaagaccaaagtccagataattaccttgtaaactagtccgaacccaccttctccaagcttatttgcatctgagaagttatttgtggcagctctaagggcacccaaatcaaataataatgattctgaacttctgaactcttcctcatctccatcaattactgacagagcaatctcaactacataaaaatccagcccatttgtcttcaattggatttcttaaagcaatagtgcagcaagaaaaacttacaaagttcttttctaaacactttccttcttcgtaagcagatacagatggcgaaaaggaccatcaatacagcaacgacagagatggcaacaattagtactacttttgtagtgttgttacttttccctgcaccaaaagaaaagttagcaaatagaaatacaatgtcatttgggaacgaagatataaacaagacccaattaaactgcaaatcgcctaccatacactctaaagaccaaaaacttaaattacttattgcttagacacgacctattttccttctaagaaatcgaaactagcaataaataacttttttttcgaagtttataaaccagggtggactcttatagcctgaagtgaagttctatgacataactcagcagtcaagttgcttaagattagtacatttgacagtgcaatgagaatagcatttattctcctgcatgtttcccaaagctgtggtacatgtggggttccagttgtaatcttccgcaaaagaatgattgatcttctttccgttggattgcatctgtacagatctcaaaataattcagatctctcatccatttattcgcacagatctcaaaacaatgattgcatcaatccaataacggatccgtgccaaaatagataaattcttttttatatgttaaataaagatggcaacgaatcggattggataagccattatacatatccatcccatacgatagaggttcgggatgggtcaggatggatacggttaaataagatgagttggataggataaacttacaaaaatcaatttttcaacatacaaattattattttttcttcataaaaaaaaaaaatatatatatatatatatacatatatatatatatatatatatatatatatagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaataaatatatatatatatatacatatatatatatatatatatatatatatatataaggatctgaatcagagcaaaccttaccattatctatacgtatccagatcaattgcaaactgagtaaaatccaccccattctaattgtttgtattacaacactgtccggcacagaatgttcctcccggagctaagagtaactcctccacccccaccacccacaccccccccgcccccaccaccccaccaccaaaaaaacaaaaaaacaaaaaaaaggatgacagcagcataggccaccaacatgctttgcggtccgaaggttattaaaactaaatttattcgtattcccagaaacaaaatccgtttcatcaggaaaaaagtgcaaaaacaacaaaaaggaagttccgaatacggttcaaagcacacatggttctaaagattaaattactatatggaactcatgacaaaggagtagaaaactgaagatgtaaattcgctgttaaagccagccaaattaacaggataactaacaaagccccagagactgaaattttcttgtggtgctctatacttatcggagcgactcgtcgtatcgtcgaaatcaactactactcaacacaatatccaccaaacttttttgttaaactaaatcattcctgagggaggtattctacgtcaagggaagaactttgcttaccatcaccggtcgtgtctgtgccattgccgctgttccgcgaagaactcgatcccggcggcggcggagggataaacgactgggcgaagaagggataggtctcaaacctcacggtacagctcaccttcaaggcctgtgccccgatatgcccatagcagcagataggcagacaaccggccgccttatcgagacacgtggagcaatccgtctccgatagatcacgggtgcactgtgccatcgcatatatattctcgtactgcgagaaatttgccatccccaccccaaacttcgattccctctccgccgcctgcgacgagatctcgtccatcagatccctaatctgccgatagaaccccgttggatccgacgcgttataattattgtatatcgtccggagctggtcgtctacgggccggccgaagaagctttggtcggagtaatggaggatgcagtagtcgaagcggatggcggcggacttgcggaggtggcagcgggtggtggcggccgaggcggagaggttgaggcaggtggaacagtcagaggcggagatgtcgggtcggcattgggcaaggccgtaggcgggggctgaggaggctgcgccgacggtggtgttggagaagtagccggcgtcgtggggggaggaggtgaggttgaagaggaggaggtccaggttggcggagaaggtgctggggacggtgtagttggtgtcgccggcgcaataggtgaggatggggtcagtctgggaataagttttggtcggagctagaagcagagtatggaggattagcagagggaatagagacaagatggatgccatgaactgggaagaggagggacagagttggaatggagatgttgttcgtcacagcttctgtttcgggatgtggctggagagcatgctggaggtgaaaacagccgatttaatgggagtggcattaggcacttttattttccgggataaattatgttatgatgtccaaacaacaccgaattatcttaaatgatccttgaattttaaaatcctaaactttaatctccgatctgaatcgatttattgtggtccccagatatgattccaacagttttatctcaccgaaaatctgatctatcaaaaaacggtgcatacatggatgacctttctctgccggtgttgatatggatttaaatccttttaaaaaaaagatgctgacatggtcaaaataggtgattaggcagtgtaaaccgtctggacaaatattttacgctattttttcctcccatgctctaattcagaagatgcctcttcttctctaatccaaacccccttcttcttctccaattcaaacaagaatatcgattttcagtcgggatttctttgtagaggcactagaggggcaagtcggccttcttctatagtgttcattaagatttcatccttcttcttccgcaatattcgtcagtcagcatttctttgcatctttcttctccgtcgaactgagatattcttcctacatttatcacattggttttataatttgcacgtatgcaatgtatatgaattagagtatacaagtttaaaaattttgttgttttttgtttgtcattatgaaaccaagggtttgggataaaaggagtccatagaggggtatatatcatcaccaactagagcatacatgctttcctttgtggcctgcggtagtagttgagatgggtttgaaagagattcatcagtttgtatggtgctttatttaacaattgaagttatactctgtatactctatttttagattgaattgaagatgttgggtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatgatcctcagcacatgtgttgtgttttaaatggttctcattcttgatgctctatttgtcaattgaacctagttctttattaaaatatatattatggtatatgtataaacctcaaagtatttgtcaatattttaaatggtccacatacttcggaaaccaatcaatatgttatttgtttttttaagttcaatggttagtctttttgtatgcatgtacgcattgttaggtagtagattgctcaatattgtgtttttgttaagatgcattagtatatgatttcttttaacatacttctctatatatcctttttctaaatgatcactaatcttcaaagaatatataatttagtccttagagcatcggtggatatggcttctgacatgttttctaataacaattcatcatgatgggaaattcaattttatacctaccttaagatatgttggagggcaaattttgatttttgacaatgtgaatcctaataaattctctattttggagatggagagcatgttgagggatattggggtttctgatttttcttaatcttactatgtgaaggcaggaaaagatttgaataatggattgaagttcattttttatgatcaaaatattttagacatggtttcagatattcctccagatggtatgatatatatttatgtagaatatagagatgaagttgtgagtgctcagtagaaagctgtgccagagccagtgcaacagaagcaactgcggccttatttacttgccaagccattacttaatttagagtatgtgcctatttatttacatgaagaacctgctagagaaggaagtgaggatgttaggactaaaggcagtaaggaagttggggttgaacaaagtggaagtgagagtgatagaagcattaatttggatgacatatatgacaatgatcacatggggagttatgatgaggaggtacaatttagggttgaagagtctgaatctagggctgtagaggctaaacttagagctaaacaggctgaaactagggctggatcatcgaaacccagggcttaagagggtgaaatccagctggatgtttcctcagactatgcaaatagtaatgatttagattcacatgaatcttcagatgagaagagagatgatacattcgaactttttagagagaaaactaatttaggcaatgttcaatttaagttgggcatgaaattcaagaactttgcaatcctcaaatcagtaattagagagcatgcaattaatgagggtcacaatgttaagttggtgaaaaatgacaaggtgaaggtaagagcaacatgccatagcaattgtaggtaaaaattgcatgcttctttgatgtaggatggatcaattggacatattaagtcttatcatgagtatacttgttgtaggaaggtttggaataggaatataaaatcaagttatttagtcaataagtatcttaaaaggttcaagagttagccctcttagaagccaagaaagttggttgcccaaattaggcaggatttcaatacacaaatatcaatatctcaagcttattggataaaaaagaaggctatagagatgatccataagagtacagcaaagcaatacagcagactataggattatgtcgaggagattagaaggataaataaaaatagcatagtgaaaatgcttcttgatatacaagaacccaagggtccatctatttttaaaagattttatagcattttgctacttgtaagcaagattttctggatgcactataaaaaatagcttattagcgacggctattagtgacagcaataagctgtcgctaataagcatatttatcgataacttattacgatggaaactggatctatcgtaataagtgcaaagagttattagcgatggtgatttttgttatagcgatggctatccgtcgctaataacttaaaatcctattagtgacggctttagcgatgcaatttagccgtcactaataataagccctaaaaacctcccatggatccccaatgggctcacaaagcccctgtcgtctcccctttctccaccatcggctccactttctcccctttctctagttgcccttctctcccaccgcactatcggagcccccaacctcctccccccagcctcgcgccactgtctttacactgaatcgaccgttcttgagcccccttcttcctcagcactgccggctgcctcccagagccagcatcctgttgccccggcctcccttcttcttcccgacctctcctcttcctttcctaccgtcgtgccccgccgaatcacccttccctttatcggatcgatcgtgccccacctcccccttattccctcgcctccccctttcttcccttgctgtgccatcagagtgcctcattgtcagacccgcacctctgcctctctccttcggagtgtccagccatcgggtccacaccaccgtcagactgcacagtgcttgatgagtattggcaacgacagcagctccgtcgtggtcgccacaccccattctcatctttttaaattttaaatattaaaaattaaatttatccaattaatttaaattaataatatttgaatttaaatattattaatttaaatattaataatatttaaattaataatattattaatttaaataatattattgatattattattaaaattaataatattatcaataatatttttaaattaatattattcttgagaggtagaaccatttcgaaaagctctctgataaaagtagccctactatcttcgacgataggagttcaaggttggtccattattggattggctttggcccactcatctactttggcggtggtcagagtagctcgatgattggattttaggctctagatctgatccaaagttcgaaaaaattttttggatcggactcaaggaggggtgtggcttagcccaacctgacctgttttcaatcttatttgcaatgttgcttggtactttgaaatctttaagatggaatttatctttatgccatgctggtgtgctcgtgtgatctagtcgtctggcacgtcctaagtccacatgcgcaagatatgcatcacgaccatccccatttgcaatgatgctatgtactttggaacccattaatttaaaaattttaaaaatattacattgtatgtaactatagatgcatcttttgattaatatatatactctatggcatctatacatttatatatttttatacaaataggagaattatgtacattaatgatcaattgattgtccagtatggatagtttgaaaaatataattaattccataagtcgttacaataatcaaatggtacgatgagggtttgagaaaaatttcaaacaatattttactttaattcttctcatacatcttacgctatgtggggagaactaaagagagatattgctgaaatttctttcggcccctagtacgtatcgtctgattactgtacttaacttatagaattaatgtaatttctgaacgggataggaccttctatatctattagttgatggcaggatgtaattattatataagccatttgaaatgataaaataatcatttagctgttgccttgcatttgtatatgcagaattattaggtaatgcatgagggatcgtagttagatgaaccatcgagtagtcgatgaggtgatttctgctgaatataaagtgggtgtaaagtatttctatgattatgcttttagaaatatgatactcttacatcaaggataggctcctagtccttgtaagagatgtgacaatagagaaatacttgatagggatacaatgattatttatttatataagagtggatttatgcctaactacaagcactggtacctgcatggagagacatgagagatagttgtaagggttagaaatgagtagaacaatgacacagatataatgatagacatggctatggatgctactagttctgaatttaactgaaatatggagaatgatctagaagttggcagcagcgatttctatcatatgttgagagatgctgataaactactatagtggggatgtgaaacacatactgtactattagctgtattagagttgttgaacttaaaggttaagtttaatatgatagtcaaatgttatgataagatggtagcaatcataaaaaaaaatgctactgaaggatgaaaagcttgttgggagtttctatacttcaaaaaatatgataaaaggattaggtatgggatacgagaagatagatgcatgccgtaatgattgcatgcttttctataaggagaaccaactgaagggctcatgtgatgtatgtggtaaaaatcgatttaagctaaggcaagaaaatagaaataaaaaaaatatatcatacaagattcttcgataccttcccctcacttctaggctttggaggctctacttgtccaaaagtactgctagacatatgagatggcataaaaaaagaatttacaagcactttgatatgatgactcatccgttggatagtgaagcatgaaagaaatttgatgcttgccatcctttatttgctcaaaaatcatgcaatattagactaggtctatttatcgatgggtttacactgttcagtcatgcaacagcaccttattcatattgaccgatctttattactccatacaatctgtagcttgagatgtgcatgaaagaatataatatcttttttacattagtcattcctggatcacgacattctggtagaaatattgatgtatatctaaggcctcttattggtgagctgaaattcttatgatccgatggcatacatacttttgatgtatcaaaaaagtagaatttcataataaaggctacgttaatatggaccattagcgatttgcctacttatgggatgctgtcacattggagcactcatggaaagctagcatgtctctattgcatggagaatacaaaagtatttcaatttgagtacgatcgtaagctttgctggtttgattgtcatcatcaatttcttcccgagcatcatttttttgaaagtagtgggacagttttagaaggaataaagtagataagcatgaggcacccccatgatttaatggcatgaaagtgtttcagagggtatctcaagtagatgaagtccagtttgacatactatttgacaagcagaaacttcgaaggttcggtagaactcataactggatgaaatgtagtatcttttgagaattattgtactgatccatcaatttaattcatcataatctttatgtcttgcactttgaaaagaatgtatttgataatattttctatactattataaatattaagagcaagatgtaggacaacctcaaggcccgagcaatataaagaacatatgcaagcatcctttatcagagttggttgaggtgtctccgaagaaatttctgaagtcaaaagtaacttacaccttaatgagagagcagttgaaagacatatgtgaatggtgcaaaagtcttaaatttttatatggttatgcaagtaatctagctcggtatgtcaatatcaaagattaattataagttgtatgggctaaaaagccatgactatcatatctttatgcaatgattactttcattggcttggcatgatctccttcccaaccctatatagagttctttgatgagcttagtcttttttgtagagacagttgtgctaccaaactatccaccgactacatcttcagtcttaaggctagcaatgtaaagagtacatgcaagttggagaagatattctctcctaattttttgactctatgaagcatctcatgattcgtctaacatatgaagctaagattaggggactagtgtagtacagatagatgtaccaatttgaaagatacatgcacagtctcaaaatgaaagtaaaaaataaagtcagagtcgaagattctattgtggaggcttacataattgaaaaaaattttaatttcagtcgatactattttaacaccaatgtgcagataaagctgactcaagtgggtcgaaatcatgatgatggtggtcaaggatcagaggtgaagaatttaatatttacctatctcgcttgtaaatttgggcacgaggttcgtcgggtattaactaatattgaaatttgataggccagagatatatgttttgctaaactgtatgaaggtcgacccatatattgagtaagtatttatcataatctcaactctttaatcacttatcattctatacttatcttatgcatgtataagcaatatgatgagatgttgagatgggacaaccagatgataagtgaggaagaaattttcactcagcacacaaaattttacaaattggtttgaccaattggaagcgaccattatctaatcatctattttaattttttaaatttattctttttataatatgcaagtcatgtaagagggtaaatccatacctaagaagctaagaccattaggttacagaccatcaaaatacatgacatgttataatggctgtaatataaatagttttaaatttcacatccagtaatatggatatcataaaagtataatgaacagtagtatgtgtacaaagggcagctagtcagaagaggtggatagtgactactatgaaatcctcgaaaaagtgatcaagttgacctacctttgaggtaatagtattattcttttaagtgtcgatggtttgatactgacaattatatgaagattgatccacagcatgaatttattgaaatcaaacatagatcaaaagcatatgtcaacgatccttttgtgctagcttaataagctattcaagtatattatacttctttctatcaagagagagaggaaggaaagattgatgagctgtatgtaaaattaattctcgagttattaattacgagcttaaagatgaagaaaaagagctccatttaccagaatactttcaggaggatgaaatattaggagtttatcagtttaccagaatacttttaggaggatgacatattaggagtttatcagtctttaatagatgtagagttagatgctccagaaattctcctacatgatggacaacatgaggagatagatcatactaagtttatttgaaaggacaatcctatcaaagaagatgaagaagaggaagaagaggaagaagtggaagaaaatgaggaagagaaagaatcagaagaagaatctgatgggtaccaaatatctgaagaggccgatgagtagtcgaccctaggaaagaaagtcgatcccatgataaatgaagcagtttttgtctttgtggtgtgcttgttttatttatttttcatacttacattatatcatttcaattattgcattgcttgccataattgtataattaatccatgaatctatttatttttatttgcagagattataggatgactactcccagaggacggggttgtgctagccaaggagcgagctccagaggacaaagctttagaggagatagctctcgtgcgggcagctcacatggttcagcggcacccacaccacgagataaacataacactttagaaattctccattaggttattttgtccttcattatctaatataatattctttatgatcttttactatactcaagtttggatgatgtggggtcaccattgaccccatagtcatataaagcagcggttggctctcaacctcaacaccgtggtaaaggatccgtctggcttgcagcacctctgacttgattagatgatagaaaatttatgcatatttagagccgctcgtaagtactagatctttgaagaatatatttaaaaaaatttattcattttagaatcaatattgattgttcaaaatcaattttgcaggacatttagggagcctggggtgttgggatcatctgacgattgatgttagggcctgtgaatgagttcttcagttggccatcaggggctcatgatgctgcatggagatattcgtgataagtcaaagatatttaattattaaatttatggtacataagaatgtttgtattctatttattaatacatgccatcctttacttgcaatcatactatcgattcgagactcttgaggatgaggaggccagctgttagaccttcaaggaggttgtcacatgatggcactgggatgggctgtaccaactcaggcaagccatcattaagttctccagttttgagtcaccatcagactggaagtccttcacagatcattagatacagacggatgtataggaggccctctatgaccagtggagtagtaaggagtactcctgtgatacccagaattttaaaacaaaacccacttaaattaaaaaaaaattgaactagcaagtgcaatgcacgtgctggaaatcaacgtgcaaagaggggaatgcacgcgagttcttttcttctctggattgggagtcctaaaatccattagaaattgagatgaattagaactctaaaacctccctatttgaggtctatttaaaggcctaaatccttattttttccttattgaaaaatctctaaaacaatcactattttcttccctattttctttccattttttcagtaggtttgcttttaatttatccataaaaaaatcagctcaaaattccatctaaattaggtaaatctcttcccttttgttccctcaatccttcttgggttttaatcttaaaattttctgagttttttgttgaaaatcccttgaaaattattgtttatcccaaattccttgttttgtcttccatgtttgatttttcgatgcttgagctgttgccggtcaacggactaggccagttgtcgccatctgggatttcttctttggccttaagggtcaccaacaggagtagtttccatcttagcccaggaacaaggggagcaagagctcccctgttctgtgaatgaagaagaagaagggaaagaggatgcacaagtcctctatcttccatgaagaaataaagggaaaagaaaagaaaaaaagagaaaaagaattttttctctttcttctctttttctcccttccttctctcttcactttctctctctattttctttctctaatttttttttctttaaatttttcttctctaccatgtttgttgtctctctctctctctatttttttggatttatgaaattaaggatccactgtctgtgcttagtttgatcttgacctaaaaatttaattaggaaaaatacaaccaatctttgatctaattttaagtagaattttgatttaaaatttattttttgaattataattgatataatagtataattttgaataataagttctgaagagtctcctcagggttaatcaattttttgttcaatattctgagaaaggtaagtcatgaaccatctttttgagatattttataatttattttgaaaataaataattattttttgaaattatgtatgatttatgaaattatatttggatgaaaagtgattctgaaatactatagtttattaattatacgtatgttcagtaaaaattatgatatattatgatacaaaagtactttgatataaatcgaatttatgctctcagcataactatattttagtaagcttcgtcaatgaaaattatacattgataattaatgggctccatccataaagattatatgttggtactcagtagactctatcaatggaagttgtgcactggtatttagtggaccctgccagtgggggttgtgtgctggtatttggtagaccccatcaataggggttaaacattagtcatagttaagactattgaattatgagtattttgattcgaatcagatttatgattatattatatatgaatatttaaaaagattggatttgcattgaataagcatgaaatatattcttatgtttattcatggtattatttttgaatattatataatatctgaaatatctagttgagatattcgttacttactaagctttcaagctcatcatctcttttttttatattttagatttaaataattaattacaagcgtgggtattaattttgaaagagagcttttagaagcgagatttggcactatcagcttcattgaacttagatctattttttattttagtaaaattttatttgatataagatatttaaattatttaattatttaaattaaaattaaataataattatttaaattttattccactgtgatgcattgatatgatatgagatatcttatgtgctcatggagagagttttctatgagtgtgcggtggttgccatgactcctgatccataatttcagatcagaagcatgacaattaatatggtatcaaagtataagtggataaattatgacatattgaattagacatgagtgtaggtgggcggacactagggacatgaggatgataacttttattggttgtgacataatttaaaaacttatatttgacataagtatattgatagatttgaatcagagtctggattatttttaaactaattagaatagtaatttgatttgaaagatatggtgatgaaagattcaattttgaaagtagaggattgattatgacttgaggtaaaaagtaaccttgaatgtttaaggatttaagtaagaaaaatttcaaggatgaaattatttttaagggatagaatgtaatacccaaaattttaaaacaaaatccactaaaattttaataaaaaaattaaaccagcatgtgcaatgcatgtgctagaaattagcatgcaaagaggggaacgcatgcaagtttttttcttctccagattgggagtcctaaaatccataaaaaattgagatgaattagaactctaaaactttcctatttgaggtctatttaaaggcctaaatcctcactttttccttatcaaaaaatctccaaaacaatcattgttttcttccctcttttctttccattttttcagcaggtttgcttttaatttggccatcaaaaaatcagctcaaaatcccatctaaatcaggtaaatctcttttctcttgttccctcaatgcttcttggctttaatcttaaaattttctaagttttttttgttgaaaatcccttgaaaatcattgtttttcccaaattccctattttgtcttccgtgcttgatttttcgatgcctgagccatcgtcggtcatcggactaggtcagttgtcgctgttcaggattccttctctagtcttaggggtcatcgatgggagtagttgccgtcttagcctaggaataaggggagcaagagctcccctattccatgaatgaagaagaagaaggggaagaggatgcacaggtcctctctctcccatgaaggaaaaaaaagaaaaaaaaaaagaaaaaagaagaaaaaaagaaaaaaaaaagaaaagatttttttctctttcctctctttttctcccttccttctctcttcacgttctctctttactttctctctctaaattttccctctccaccatgtttgttgtctctctctattttcttggatttatgaaattaaggatccattgtccatgcttagtttgatcttgccctaaaaatttaattaggaaaaacacaaccaatcttcgatatgattttaagtgaaattttgatttgaaatttattttttgaattaaaatgatataatagtataattttgaataatatgtttcgaagagtcttctcaagattaatcaatttgttgttcagtgttctaagaaagatgagtaataaaccatcttcttgagatatttcataattcattttgaatgcaaataattttttttaaaattatgcacaatttataaaattatattttggatgaaaagtgattctgaaatactatagtttattgattatgcatatattcaataaaaattattatatgttatgatacaaaagtattttgatatgaatcggatttatgctcctagtctaactatatttcaatgggctccatcaataaaaattatacgttgataatcagtggaccttgctaatggggattatatgttgatgctcagtggatcctgccagtgggagttgtgcactgatatttagtggaccctgttagtgaggattgtgcattggtattcagtagaccccgtcaatggtggttaaacgttggtcatagtcgaggctattgagttatgaatattttgattcgagtcagatttatgattatgttgtatatgaatatttgaaaagattagatttgcattgaattagcatgaaatatattctaatattattcatgttattatttttgaatattatataatatcttaaatgtctagttgagatattcattacttactgttgggtataaaatacccacagccgaagttctcagtgggattaacccttgcgggctccgtccacaactccgaggggactccgcccagactcctacgggagccgggctccgtcgccaacttcaactgccggtaagctccgtccggactcctacgggagccggacttcgcacctgacttcaaccgcgaggaggactccgcccggactcctacgggagccgggctccgtcaccaacttcaactgtcggtaagcttcatccggactactatgggagccggacttcgcacctgacttcaatcgcaaggaggactccgcccggactcctacgggagccgggctccgcccacaacttcaaccgcgaggaggactccgcccggactcctacgggagccgggctccgtcgccaacttcaactaccggtaagctccgcctggactcctacgggagccgggctccgcccacgacttcaaccgcgaggaggactccgtccggactcctacgggagccgggctccgtcgccaacttcaattgccggtaagctccgcctggactcctacgggagctgggctccgcccacgacttcaactgccggtaagctccgtccgaactcctacgggagccagacttcgcccctgactttaattgcaggaggactccgcctcaactcctatgggagctgggctccatcaccaactcataccgcgagaaggactctgcccagactcctacgggagccggactccgcccataactccaactgcaagcggactccgcccggactcctacgggagccgggctccgtccccaacttcaactgctgacactccagccggacttcggccggtagaccttcactccctggcgcgccgcagtaacggccgcgattctgttccacaccctgcggcagatttcacgcggctccaccactccacgactctgctccacctcctgcgatggattccatgcggttccattactccctggcaggccgtaataatggtcacggtcctgctccactttctgcgacagataccgcgtgattcttccgttctctggcaagtcacgacaacggacatcgctcagctcctcatggcagactccacgtggcacaccccgatgatagccacgggtccactccactactcttcgcaacaaacttctcctgactatgggcggcccactgccagacggttacaggcatcgctatcagtttgttgccccctccgcctataaaaggcggaaccccagatacgttattccataagctcttgtttttacctagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaccagaatccgacggcgaggcaggccgcttgggccagccgccccgtccttcctggaaaaatgaacctgagggtggagagccctcaatcggaccacgactccacccctggaagatccctgtccccgttctgccagaggaccctcgagactcgaagtcgggaggatttcctagatcggagacttcaagagatgaaccggcggatcgaagaactccgccatgctccccccgctcatggtgaggatatttgcactgaccctcccttctctcaaatgatcatgcaggaaccgatcctgccaaactttaagctcccccagttcgaaagctatgacgggacttcggacccggtcgatcatctggaagccttctggacgatgatgctgcttcacggtgctcccgatgtcattctatgccgggccttcccatccaccttgaagggagcggcgagaaactggtacttggctctgaaatcgggtaccatcttttccttcgattaaatgagccaccaatttgtggcccattttgtcagcagccggcacccccggaagggttcggagtcccttatcaatatcaagcagagggaagggaagtcaattcgggcctacatcaaccgtttcaacatcgcggtgctggaggtccggaacttggaccagtcagtcgcaatggccgctctgaagggcggccttcagaagaatgaccttttgttctccctggagaagaagtaccctagggattttgctgatttgttggctcgggctgaaggatacgcccgagcggaagaaaccttcaaaatgaaggatgaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttctgtctctaccaccgcgaccacggccacgacacagaggaatgcatccagctccgagatgagatcgaggagctcatccggtgaggtcagctcgacaggttcatccggcaccggcctgagggtagaggagatcgaccaagggccctgccgcaacctgaaccgccaagaagggaggagcagtccggagatcgacctcccatcgggaccatcgactccatcgccggagggcctcaaggagaagcagacctcccgcaaccgtgggactcgggaaacctgtaaatgtgtcgcttacgatttcaccttgaatctaaattcctttttacttgacgtgctcttcccatttggcatggatttgtcacgactgggcaccaacacccttcaaacgcctaaaacaaagttatgttaggaacggggggagaacctcatcctaacatacctaaaatgaaagtctgattatctcgagatcggattgagggagaggccttacaatgccctaatgtgcccccacaaccatgtcaggaacaggaggagaacctcatcctggcatgagcaaagtcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttcttttagaccggatggggggagaggccttacagcgccctaatgtgcccccacagccatgtcaggaacaggaggaggacctcatcctgacatgagcaaagtcaaaggcccggttcttttagaccggatggggggagaggccttacagtgccctaacgcacccccacggccatgtcgagaataggaggagaacctcgccctgacttgagcaaagtcgaaggcccggactcctacgggagccgggctccgtccacaacttctgcaagcaaggaagactccaccaggactcctacgggagccgggctccatccacgatgccaaggaagactccgcccggactcctatgggagccgggctccgtccataacttctgcagcaaggaagactccgcccgaactcctacgggagccaggctccgtccataacttctgcagcaaggaagacttcgtccggactcctacgggagtcgggctccgtccacgatgccaaagaagactccgctcggactcctacgggagccgggctccgtccacaacttctgctgcaaggaagactccgcccggactcctacgggagtcgggctctgtccacgatgccaaggaagactccgcccggactcctacgggagtcggcctccatccacaacttctgctgcaaggaagactccgcccggactcctacgggagccgggctccgtccacgacgccaaggaagactccgcccaggctccgtccacaacttctgctgcgaggaagactccgcctggactcctatgggagccgggctccgtccacgacgtcaaggaagactccgcccagactcctacgagagccgggctctgtccacaacttctgctgtaaggaagactccgcccaaactcccacgggagtcgggctctgtccacgacgccaaggaagactccgcccggactcctacgggagccaggctccgtccataacttctactgcaaggaagactccgcctggactcctacgggagccgggctccacccatgacttctgcggcaaggaagactccgcccgccctggcgatggcccctcacgtgcccctgcgggaacgggaggagagcctcatcctgatggtgacgaaacccgaccgcccaacaagatcgaatgaagggaaaaagcccctcagcggcacctccacactcctatacaaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggactcctacgggagccgggctccgtcgccaacttcaactgccggtaagctccgccggactcctacgggagccggacttcgcacctgacttcaatcccgaggaggactccgcccggactcctacgggagccgggctccgtcgccaacttcaactgccggtaagcttcgtccggactcctacgggagccagacttcacacctgacttcaatcgcaaggaggactccgcccggactcctacgggagccgggctctgcccacgacttcaaccgcgaggaggactccgcccggactcctacgggagccgagctccatcgccaacttcaactgtcggtaagctccgcccggactcctacgggagccgggctctgcccacgacttcaaccgcgaggaggactccgcccggactcctacgggagccgggctctgtcgccaacttcaactgccggtaagctccgcccggattcctacgggagccgggctccgcccacggcttcaactgccggtaagctccatccggactcctacgggagccagacttcgcccctgactttaattgcaggaggactccgcctcaactcctatgggagtcaggctccgtcaccaactcagaccgcgagaaggactctgcccggactcctacgggagccggactccgcccacaactccaactgcaagcggactccgcccggactcctacgggagccgggctccgtccccaacttcaacagctgacactccagctggacttcggccggtagaccttcactccctggcgcaccgcagtaacggccgcgattctgcttcactccctgcggcagattccacgcggctccaccactccacgactctgctccacctcctgcgacagattccacgcggtttcattactccctggcaggccgtaataatggccacgatcctgctccacttcctgcgacggataccacgtgattcttccattctctggcaagtcacgacaacggacaccgctcagctcctcatggcagactccacgcggcacaccccggtgatagccacgggtccactccactactcttcgcaacaaacttctcctgactatgggcggcccactgccagacggttacaggcatcgctatcagtttgttgccccctccgcctataaaaggaggaaccccagatacgttattccataagctcttatttttacctagaaactctgctaaaattttcgttcgagcactccattcttgttgaggcagagaactgacttgagcgtcggagggtcttgccggagcaaccccacctccgatttagacttcttttgcaggtcccggcggcgaccgcgactccttcgactccagcttctctggcgcaagcagatttttgcaccaacacttactaagctttcaagctcatcatctttctcttttattttttagatttagataattaattacgagcacgggcattaattttggaagaaagcttttagaagtaagatttggtgctatcagcttcattgaacttaaatctatttttttattttaataaatttttatttgatataagatatttaaattatttagttgtttgaattaaagtcgaataataattacttaaattttattctactgtgatgcattgatattatgatgaaatgccttgtgtgcttgtgggaagagtttcctataagtgtgtggtagttgtcatgacccatagtccacgatctcgattgggggtgcgacaattttggtagatgacagagggcctaatagaatcagaccgtcaagcaagattcgatcaagcacaccgatgacttcattggcacacatgttatagcagatagattgataaaaattctcaacttatattattctcatatttagtgaatcatatgttagtttttattaacttgatttttttatttattatagacacggcaatttggtcgtgtaccatggtagttgcagttgtgggaggccatgcacaagtctaggaggactgatgattacttagattctagatctagatggatcatgataaaataaaatattatttattaagtttttatatatattgatatgtataatagcactaacaaatttttaaattatataagtggattatgcggagtacgtcgtagcacggcacggtgaggacctatcctctcagcccctctttgacctcaagggatggcttagggccaccaaaagggttactaggagctgggtcatagggttcaggcatagtttcgaccctctagtagctcgttgatcttcgacgtcctcctctcagaccttgacgacccagacgtagggtgatgcgcatgttgagaggttgtgcagaggcttttttgctgatgacctcaaagttttcgggatgacatccgtgatacgatagttgagattcttcgagacccatatctgcatgatcagctgagctcattgtcactgccatcacagttggtaagtcaagcagtattaataaacttttttacttgctttaaatttttatatttagaagcttcaaatagttaggcttgagtcggaggaaggagatctaggggtcaaaagtcaatcttcctatccgatgggcaaatggaggtatagatacgtctgtatcatcaaatgaaacgtataagaataatccattcgagaatcgaaggagtatatcgaaatatatccctccatgtcgatttagacttgagaaaggaggaaggggtatcagggggtcaaaatttaatctaaccatccgatggatgggtctgagatgtctatagctttatatgatcgaatagaacgtgtaaaaataatccattcaaaaattgaaggagtatatcaaaatatatctatttgtgctagtttaggcttcaaacgggagcgagggagtatccaaagggtcaaaattcaactagctagagatctatagcttcatatcaatgaatgaaatatatagaaataatccatttaagaatcagaatagtatattaaaatatatctcttcataaagatttagactggagatgtatcaattacaatagttttatagtttcaattaatttagttctaaagttattaataatattttatttttttattataggatgttgagacatctgactttcatctatctgctgctgtagaggacgtacaggagcagaagcagaagcaggaggaggaggacaatctccattgattttgtttagttttggtgtaatgtattggaaatttgagcaaggttgtttacacaattaaattttggtgtgatatataatattagttttttatttatgatgatgatagttaattgttagttgcttattaattatatgttacatgttaatttaattataatagattttagtaaatataattattttttaattaaattataatatattttaataaatataattattaaaaatattttttaaaaaatatataattattagcgatagttttaacaatggaagctctgttgctactaagtattagtgacgactgactagagataaaaagccatcgctaatactattttttaaatttttaatttcaaatttagaaaatattataagcgacgaagtatcatcactaatatccttattagcgatagctagtctgttgttgttaatatgctacgttagtgtcgagcttttttttgatgactttttagcgatggtgccccatcgctaatagcattagcgatgatattttggttattagtgatgacatttaaccatcgctaataatgtttgcaggcctataattgccgtagatgcttgtcacttaaaaggatcttatttgggtcagttaattgctacaattggaattgatgaaaatgacgaaatatacctgactgccagagttattgttgaagctgaattgaaagacagctggttttggttcttggagcttcttcatcttaacattggctcgtatagggatagaagatggacattcatttctgactagtagaaggtaccattatagtttacataattatattgcacaaagattattttagttatgatagtgtatatagtgtatgcattaatggtattccatggttcatgcagggtttgctgcctacattggatgatctaccatcaggggttgaccatagattttatgtctatcatttgtttgagaattttaaggcaaagttcaagggcttgatacttaaggatgccctgtgaaaggcaacaaaggctactataagggtagattttgagttccaactaaatctaatggaacaaattgatctagctgcatatcaatggttgatgactgtgaaggatgtcgcacattcgggaacatgtatgcagaaatcaaaacatacagatttttaatttttaaaaatcataaacatagcaaaataaaaatctgatctagattaaatactttaatctatctaagatgtatgaagtagatctaatctacatgcaacaaaattgatcacatgcttttaagatgctgaaaataaattatatttaaatataactaaaagtccaagatcaaatctcaatacctttgcgtgggtagcctttcatcgtaatatgatgatcttgataatttgatgagctcctcgacaagccacacatacgtccgatctctacggatatccatataaagtcttcgatctgattagaggcttctgacttcatgcaggtgctaactcccttgcagaagacatctcctgatagttgattctgatttcttcttcagatctctgagactctttcagatctttgaagaggaatgagaggaagaatggagaaggaagaagatgtgaaggaggaagaagaaagctttagagaaaatctatttctctttatttttgtctctttccaaaaccctagatgaaatcctaaggatctcacaccaagagaagatgcctctcctcaagtttctcatgcatacaaggaagcccacacccctcttattttttctcacaccccgatcttagatatgatgcctcctttcttatgttttcatcataaattatatacttttgtcgcacaatagaaaagatattttgtaggtggcgtccaagagattgcataaggtcaaacctcatcctgataaggaatcaaatttttaaaccttatcttttttgggtgttgagaaaagaggcgtggagatcatttttaacatgctcatcttcatacaaaaattaggaaacatgtgaagatgtggggcacggcttcttatggcatgtgactttatggggcgctagggagagagagtcccagtagattggaactcttctttacagtgcttaattaatttctaaccaatttagaaattggtcacacacaagaaaagaaataatccaagtctaactatgaatccaatcttctcaataagatcctaatcaaataaaaaattaattgaaccaaattcttaattaaatcaagaatcaatctcccttacaattgggttatctcataactcaattaggtttgatctaatcaaactcaaatcaagtcaaatcgaatccaattcaattagaattagtcctagccccattgctcaatcaaattgagcctattagcaatctaattgctaattaatactcctacaattcactaactcttagtgaattgctctattataactcttatactggattaattatcaatcatattgacgattagacccaatagtgactcataatcgctaatcaaccatctgattggataaaaaaaaattgtatgtgaccccatagtttttattctatctaatagtaagatatattgtgatctccatcataatatcattgaaacttttttcgatggattggaatgattccaactctgtccatcaagggtcatcgatcatcaagatgatgctcgatgagtctcacaatccatcagtgacatctagtagtatgtagtggcaattcagtagaataaaatattaaacctctaggtatagttaccgtatgatttgatccttctatcatgagtcccgacaagacagaggtcatggataacttatcaaactccatcacttgtcatatgtaatattcaatcgattcgagttcgttagtgaaatcctgtgaaaattctttttcattattcactctgccatggccgtgatcttcttaactcagtctcataaataatataggactatttcttatttatcaagatcgatagatcccatctaggtgcgcatcttactccttcagtgaacctactacagtcaatatccactataaggatccatatgattggagactatgtttatgtgtagtcaaactatagcaatcctattgaagcaattgaggcactacaggtctgaagactactcacaccaatacagcatcgagtatgtcactgacgagtagatagacatctatgtgactattcgtattggtcacacttagtactattattctctaacatcacctatactctcgctctatcatccccacactgtagacttaagactcatctatctagagaaaaataatatatctatacaccaatctaactggatcaatcatcatcctcgtgatgatccatcgatcgagagaatttagaaattaatcaccaatgatatatcctaaatttttaactcttgaaaatatgtgtcatcatcctattaattttttagatgattcatggacacaggactcaatatgaataaaaattaaactgatttattttatttaattacaaaactatgtcactagaaaggttacatgtatcggccagcttggcttctagggcatacatctaacaggctgttccaataagattctgatccagacatgcatttaagatatggccaagatgtgatatgctcctaaataatttatttgagatttttaatgcttacatactgcattaattctaaggataagttaataatataaatatcagagatgatacgcaaggctttgatgtcaaggacaattaggaagacagaagtgatgctcaaatgcaatcattcaatttgtcctcatatcatgaagaagctagagaaaaaataagaaagttttaggatactatctagcaacatgggatggtggcagcatgtatgaggttgagcatggtcttaatcagtatattatggatttgaaaaagtatgaatacaactgtttcaggtagcaattgactagtatatcttgtgcacatttgatacagtgcatatactttttaaaaaagagactggaggagttcatgcatatttactataatagagaaaactatttaagaatatactcttacttcctccaatcacctaatggatagaacatgtggcctaagactaacttagtccccccactagctccaatagtaaggaggccacctgataggccaaaaagaaaaaggagaagatatgtagatgaaccacaacacactaatccaagtagaataagaaagactatcacaatcataaggtgtggaagatgtcattttttgggacaactcaagaacttgtaggggacaactagttggaggaaatccaagataaaggaaacaaagcagagattcttctacttcagcacatgaaagccaagggcaagggagcagcaatgggagattcatgggatttagagttgcttcagaatatcatggcacataagtatgttaaaaatctgaaatatcacatcaacaatccaaacaatgtactaatgaattgattctggtatcttgcaaggatctacatttggtgggattgatgctccataggtgatgctactactgttgacagcagtcatgctggtggcatgagggctacaattggaagggctcgtgctagaaagcctccattgcataggggagctgctgggagggctactgcatcaattgagagggctccggcatcaaggactgggtccagtactggtagagcttcatctactatcaggagagcttcatctgctattgaaaggggttcatcttcatttactactgggagggcttcatcttcatctactatcgggagggcttcatcttcatgtattgtcaagaggacttcggttgcatctacatttgctgcgagggctgaagttttagctagagttaggggtgggaggattggagtttcaactagatttagggatgggaagactcaagtttcagttagatttaggagtgggagggttgaagtttcaactggagttagggatagaagagctgaaggtagggccacatttagggctggaaatgggtcgggccgagtcgagtcctacccttgcctgagcccgacccgaaataatttttcgagcttcgggccaggcttaggtccgatttttttgaaaaaatataggcccgagcccagacccgagcaaggctcgagcccgatcgagccggcccaatccaatttttcatgactctcttccccctcttaaaagaaaaaaacaaaagaaaaaaagtctaacctttaacctccaactcctccatggactgcagccaaagatatcgatatttgatccactgtcaatggcaaacagctcccatccttcccggccccttcttcttctccaactccaccgcatgctcttactgtggtgctgattgtatcatcgttgccatcgtcctctgcggtctagtcctggctgcgcttcctccggggtggcccaccgcctaatccggagtggaatctcgactagagacatcactgggggtagtggtgggagagcgacagaggggccattttgtgctcattggccggcatggttcgtggcagctgtaaggaagccatggtgatggggtttgaagacaagaatggtgaatggggggagacaagacactgcatcaactatgggtgaagatggaagatggtgatggccggcggacagacacagaccatagccccaggggctagggcattgaataagggaagggaatgggaagagaagggaacaggaagatggaacagtgaaacccgattatgtggctcgagcagtcagactagatggacttgagagttaagaggggaagaactgggttcgggcctcaggcaaaaattatcgggttgaacttcaggctaacatttgagcccgggcttgggccgggtccgacaggccaaaggtatgcccgaacccgatccaaaatataaatgggctctgcatttgagcccaagccctacttgaatttcttcgagccaagtccgaagcccgatccgaagtcggcccggcccaatgggccttgggcctctccgagcccatttctagccctagccacatttcgaccatcgagaggactgtaagggatacatctactggtagtgggagtgctagatctagttcatctgctaaataagcatttcaatatattgtacctagtgttgcttaaggctgtaagtcatgggctctctatttttggatgtaaataatgttggttttatcactttatttttgtacttacttttaaaaggtataaatggtgatcgaattccatttgatatattacagaatcaaagccaaataaagatgaccaaatgatattgtataatgaatgtggtcttgcactgttatcaatgataatatattttcaaatgcttcatattaggtgactgccagcttttatgttcccatatagtttagattttgatgaattattgttgaaattcaaaaaaaaggcttatatagtatatatctcattagtctataaaatttctgacttgtttttatttggtcctccatattactacaatgacatattgtatgatgtccgatttttgattacttccacgacatcaatattccattttttttgaattactattaaactcaaaagagtagcccgtgtagtgtatatctcataagtcaatgaactttctgagaaatttttatttggtcttcaatattactgcaatgacatatttcatccagctttatttttagttacttcctcaagttcattccaattactgatttgcagcatactttagtataaaattgacaaattgaggagtacaaaaatatttcatttgaaattgtagatgagttcattacaaacatccatttaacagccatgaacctcccattttatctacatcaaattctcaaaatatatttcaaattaattaatcccaaggtcctactattgattcttggccatcaacatgccaagaacgaaccaagtgaacaaaagcattccccaatatatatcttttctttgtcatggaagtatcccacttgatccaccgtctcatccatttcctccttaagtcgattgatgactatctttccacaggacagattttatcatcataccattcaaagtagttacatgatgaatatctcccctatacaaaagtacttatgaaagtcaaaaataagaaaaatatcaagtgggattaggacaaaaggtaactcataccctaaatcatggacaaccaaaaaccttcgatctagttttttttttttttgtccatgagatccttatttgagcctgctgcccgcaaaagtaaaacatttctccttcattatttgaagtccttgattggtgagagtctgtagatctaactgttgaacttctatccatggagattgcaattggaagaccatttaattcataagatatcgaatagaaacgagggaaatagggttccaaaaataacacatacatggaatgaagatccgcataaacctaaaatgcatatctaacttcgatgggaaagaaataagctgaagaaaatggggaaatgaagaaatgccttatggatgaacaaatgaatgtcggagatcggggaagaaataggttggagaccacaacaaaaatcgtcccttcagttcgaagtgaggaagaacatggttacagattggaggagaagaggatattaggaattctgaccacgtcaccatctttttttaaaaggatttaaatcacatcagcatcgacagagaaagattgtctacgtacgcaccgttttttatctaattggacttctggtgaaacaaaattatcggaatcatacctgaaggcaatattaaattatttcagatagttggaagattgaaatttagaattttgaagtttagaaatcacttaaaaaaaactgatttagttcatgagtcgcggacataattaatcctaagaagtttgggatttttttttgtggtgggggggcgggggggtgttctgcggtgagagtttgtggaacgtggacaaattggcgcgtgatggaagtctctgcgaggaagatggacgctgactgttctgttgcgtacgttgcacgcgacgtccgtggacggagccgagcacgagcatgcgccgaagaaaatttgggattggtagggttgactgcagtttttttttcttatttatcgctttttttgttttcttggaaaagaatcaacggcgacggaattgacagatctgatggaactatgattgaactcccggcatattcatagggaatagaatcgctaatgagctgggagtagaatcgctaatgagtgctacgattaaactatcttgtttatcatgtctagctggccggaaataaacgtctctttgagaatactattgagcactcactggttattatcttaatagctttccaccaaatcttagaattcatggggtcaagaatatcaaaattgatttttctaacatccaacaaccctttggtgtttcccaacatacactaatgagtgctcactagttattatcttaatagctttccaccagatcttggaattcattggggcaagaatatcttcctttttttttttttgaggtaaacatgggagcaagaatatcaaaattgattttcctaacatccaacaatatccaaagggttattggatgttaggaaaataggggacctcgcttcgatagtttttggttgggatgttagaaaaatatgagatctcgcttcgatagtttttggtttggatgttagaaaaatatgggatctcgcttcaatagtttttgtaacccatgtggttcatctcacctaggcatctccattccataattttcttaaaaatcaattttgatggtggtgtgacgtataagagccaatataatgggaccaagattattgtttgggattccagattagcatatatggctacataaggttgttcacttgatgatactatgatgctattgacagaattgagggtagccaaggagagggccttatgtgtgcaataactaccttaaaggtagatcacattattttagagggggacttcaaaatagtcatatcctggattatataaattgagagcatcatacgcctattcattccttgatattagatatttcaagatttaaagcaaatatcagttgatgtgttgtcaaacatgcctttcaagaggtaaatggggtggcggactaaatagcttcatatatggctaattatggtaggttagtactttatgagtcgtctttagttttacccgtttctttttaggatattgtattaatcaatgtgagtgactgcatttactttagggaccaggttagctgttggtaaataactaggctttccacaccacagaaagcttcatctccacttatataattcaatcagtaaccaagttgggaggacgacaaagacgtataatagagagacacggctgagaggacccaatagagaaacagacacgtataatagagagacaggttagctgtcgtttagctgtggctggcggtcaatttctggaggagcttaaggagtcaagggaagacccaagatggttaaacagtgcatccgagaatgttatctagttacggttcccttccaagttgctaagtaagtaaaccagagaacttttcagagttgatctttgagcctgatgcaaattggaagcttatcaatgtaagcttcaggtgagtgatcctagtggtatctgcttcacaaaaagaatggtgtcatctgcatattggaggccaaggatcccttcattcctgcagtcagggccaagacctttgatatagtccgagacactagctccgtgcagaggttagagcagatcgggtgacaaataatatacctgggcttggatttttctgtctttttccttttttccctttatttcttggtaggacagggtaatccccgaattacacaatgatactatcggttaaacaaaatgtaaatatgctaatacattcttttgcttattggtgacaaaaattgtcagctcttacatcaatcaatctcacaccactatcgtggttccatttcagtgatagaggcaccattaatagaattttgttgggtggatgtctggcttgaacaccacctttcaagactttttcagtaccacgcgatgcagcaggaagaaagaagaaacaaaacaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgaacttgttgatctctatcttgattattcctgtcttctccatcttcaatcttgctcaccaccgctgcaatctatgtccttgtactgtcttgctctgataccacttgttgggtggatgtctgacctggacaccacctttcaagaccttttcagtgccacgcgatgcaacaggaagaaagaagaaacaaaacaaaacaatcaaaatatgtggatcagccacaaaagggctcgcctccacggggcatgcatgaaaaaaaaattacaagaggagatctcatcctcaatcctcgtatacccaatttctctctgactagaagtttctctcacaaaagctctctctctcttggaagatcccctaaacccctgaagtgcccgacgaccgctgtccaggagcctcgtgctccttctctttcagtgctttgcacctctctcttcctcttcttaggttccgcacagcatcctcagcaaaaaaccctaaaccacacccttctctgttgaggcacaggccttttaaaggccttaatcaagggttaaacctaattagattaggtttaggtctcccaaacaagccaaatcaaatccctgaaccgtcggatcaagactgggagcttcctgagcccttcgatcgtgatcgatcaatgaaatagtaccgtagaccatgtgaaatgcatggaaaatgcccatgcggtccacaggcccagctgtggaccgcccgatccacggtggaacggggtaaggcccaggcaaggcgcctgggccggcccgcttgcgcgaacctaggccgcgcctgtgcgcgagcccgcgcacgggctgggcagcacgcccgcctgggccgcgtgcccgccaaacccgcccgcccgcctaggccgcgcacttgggtcacgcgccgccgcctgtggccacaccgctgtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacgcgccgccgcctgtggccacaccgctgtcgcccgccgtcggcggtcctccaccgcctcgggtctcatgccgacttcaaaagctcgtatctcctccatccaagctctatttggggtgatcttgatctcgttggactctatttttcatcgcaaactttgttgtggactcaatgtatgctgaatcttgaggcatcaaatcctaacaaatttggtatcattctcgctgttcttccaatagagtcctcgcttcctgagaaactagttcccatattcttattattcacctctgagttactggttgttccacctcttacaaagaaggcaggcatcgaaagagctggaagactgactaactagtaagcatgagcacaattgatgccatgtcatgtctttcttcaggatcatccaggatgcatagtagcccgatgtgaatgcatctcactaacttcttgcgatgtataccgatcacccaaacttcgatcgatcaactgcaactccattccttcattccttcattccttcaactgcaacttcgagcaaccattaattatggcagagatttcaataaatgcaatcgatattggtgatcgtagatcaagttatgacccaatgaatgcttatatggcttagaaggtctacagcttgcctagatccttcgaaaccattagcctccgattagtcaagatatgtattggggggtagtatgtcgtccatgttaaagacacgtgtcaatggagatctcaaatcaaatctgtccaattcccactctccaaggtcgccatcatagtgccgattggaggtaaacgactacaatcccagtggtaaatatattattttagaactatagaaaaagctacgtcaaaagaagtcatttagtacataatgaagtaatagatcttacttcagatcccaccgatcctcactctctcactgcccctttcggatgaagctcctgcagtaattgatgaaaaacctagccgatcctgacttcggccatcaacccttgctttggccgccgatcctagcttcgactgctaagcttggcattagctgccaattgtagccccactcataggtccttagccactggtaccaggttgatgttcagataacggacatcaatccaagaaaggtcctgaacccaacatcatcttcgactaaaggatcccccatcaatccttgtttctagctataagctatattcccttcaacattcgttggctaccacatttggaagagtcaacccccatgccgttatatcaagttacataatcccacatgggaccatgccactccaatggctggttgcatccgagtgaggccacatcaaatcaaaccacctctgagagtggttgactgcatatcggataaggtgacatccaccacctgtaatacccagcccatttgggccctggaccaagcccaaaccttgaaagcccaaaaaaaaaaagagaaaaaacattgaaaactcccattgggagtcttcttcaacgagaacaaatcagagaggaagtcgaatctggggaggattcgacctctcctctgccctataaaaaataccctctcctctcctctaaggctagccacgatgagcactggatcttcccccttatttttctcgatttttcttgttgaagccacggatgtcctcatcgtgttcatctcaaattctcgctagagacctcaccagagtcggaggtaagccacagccctccttcctctcttccttcccctccttcccatggcttcgtgcaccctcaccagccattgggctcgttgaaaaattcacaaaacaacaagatcctattttactctgttcggctgagctttctctctcccttttctggccaccagcgccaccgcccatggtgccacccccatgagtcatgatccccacctctctacctatcttctccaaaggtcatgacagtcggtgatcagccaatgatcgaagaaattcaaggaaagggggcggtctccaattttttcgatttatctctaaattctcactggccaaacctcaccgtcggtcatctcttgccccaccgccatcggccgccactgtcagaccaccgaccatgccactgcacttcgtcggagcatgagccaccaagcctctccctcgtgtctctcctctattcggccagggaaagaaagaagaggaaagaaagaagaagagaagaaaaagaaaagaaaagaaaaagaaggaaaaaaaggggaaaatataggaaaaggaaaaggaaagaaaagaaaagaaaaaaataaaggagagttttctctctctctttcctctctcttctctctccttctctctctaggatctttctactctgttttgttctctctctaattgcatcacggatcctaagacaaacttgagatgaaaataagatgacttgaaatcacttcaaaatttatgcagtagattggatcctagtccgatccttatttaaaatttatagcatctgatcatagttaatctatattgagtcaccttgatatgatctctgatagtttcgatcatgattatctcatctgaaagatacaaagattttctctctattttctctctctaaaattttctctctcttcatggattttctctctaaaagtcttgtggaccagtggagggtccagatacttagataaatctcaattttggttgatcctaggagaggtcctagatttatgttattaggtttatttatcaataatttcttcatatatgatttttatatttgattagggtcatgaagagatgcgactatctgcataagatatcgagtgaaatatcttatttttgaaattcataaatcaaagaattcgttgatttctatacttggatcaatctccgataaaggtaagaatctctatacatgatcatcattatatatactatttttattgttatatttatatctttggttttatatcgttggattcgtgttgatggattatcatattgagatactatggttgctcgtataattttttaatgtacatatattgtgtgttaatatgtatgtatgccattgattgatgatatgattatatagatatgacatatctaatttgatcatactgtaaatcaaaattgatttgatgaaatcaatatataataattaaataaaaaagatattatttggactagactcgtcatatgggacagtctgttcggagcttatatttgggacagcccccatgggcttatatgtggattagccagtcaggagctcatacctgagacagtccgtcaggagcttacgcctgggacaacctcccatggacttttatacgtgggacagccggtcaggagctcatgcctaagacagccttgaaaggcttatgagtagaaatttaattagatggagactgaggtatagactcggttaatccaaagtcagatagaaaaaggttaaagatcctgtgattatgaaaagagaaatagaagacaagacatgaaacaaatactgaataaaagtgtttcacccgttaacatatgatgatgcatctctttgacaagacagataatttagggatatttgcagtattctggatattgaacatgagatttcatattttattgtttatccttattttcagattatattattatactagtgtgatatgtgggattcttactgggctgtaaagctcacacccctccatatctctttttcttctcagagttacaggatgctcatggttggctatgatatggatttgcaagtggacggatgcatggattatcacaccctgaacccaacatccggatcagagacgtgatggctgcacactctttagagcaagtcctaaagaatatgcaaggccaaaatatttcattacaacctcaacatcaataatatttaatttcaataataactaataaaatttgcataattataaattaaatttcttcaatcctctgatcagatatcaataatcctctatttatgcatccgctcactcgcacatccataccatagccaatcatgagcatcctgtaactctgagaagaaaaagaaagatgaaggggtgtgagctttacagcctagtaagaatttttatatcacaccgatataataatataatctaaaaataagaataagaaataaaacataaaatctcatgttcaatatctgaaataattcaaacatctataaattatctattttgtcaaaagagatgcatcatcatatattaatgagtgaaatatttttgttcaataattatttcatgtcttgtctttcatttctcttttgattatcatatgatctttaacctttttttttggctctggactaaccaagtctatacctcaattatcatctgaatcaattttcacttaaaagcctttaaagactatcccaggatgagctcctgaccgactgtcccacgtacgaaagcccgtgagaggctgtcccaggcataagcttctgacggactgtcccaggcatgagctcctggtcggctgatctacctataagccagtgggggctgtcccaggcataagcttctggtgggttgttccatatgacaaggctagtccatttcatatctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatatatattgacataacatactcatgctcaaaatcatataagcaaataatcgtgtcttggatatagcaaattcatcaatctcaaatccaacgatgcaaaaccaatgatgcaagatcaacggtaaaatagcatatatataatagtgatcatatacagagattcttacctttatcagtgactgatccaagcataaaaatcaatgttcttcttcgatttatgaattttaaaaataagatattccactcgacatcttatacaaacaatcgtatctcttcatgatcctgatcaaatataaaaatcatatatagagaaattatcgataatcatttcttaataacataaatccaggacctctcctaggattaaccaaaattgagatttgtctgagtatctagaccctccattggtccataagacttcgagagagagaatccatgaagaaaaaaaaatttagagagagaaaattttagagggagaaagtagagagagaaagtgaagagaaaatcttcatatccttcagatgaggtaatttatgattgagatcatcagagatcatatcaaagtgactcaatatgaattaactatgatcgatgttataaattttgagtaaggaccggattgggatccaatctactagaatttcggagcaatctctgatcatcatatttttatctcaagtttatcctaaagtctgtgataaaatcagagagggagagaaagactctagagagacaaaatccatacaaagagagaaaagtctagagagagaaaatagagagagaatctagagagagaaaatagagagagaaggtagagagaaaagagaggaaagagagagaggagagagaaaattctctctttctttgttttctatttttctttttttctttctctttttctttttctttttcttttcttttcttttcttttcttctttctttctttctttctttctttttctcgttttcttcttcctttcctcttccttggccgaacagggggaggaccagagggaaggggctcgatggctcgagctccgacaaagggtggtggtgtctggtcgatggtgacagagcaaggggaggcaggcggcgaggttcggtcagcgagaaactttgagaaaatcagaaaaaataggggatccgccccttacctcttgtttcccgatcattggcctgtcgctgacggccaagacccatagggaaggaaggctaggaggtaagggtcctatcctaggggttagatgccgcaatcagcgatgctggtgatcgaaaaagagaggaaaaaatctcagtaaaaataggggttcacctttcatggacttttcgatgagctggacggccggtgagggtgcaccgtgccgtggaaaggaggggaaaaaagaggaaaaagaggagaagggcttaccttcatctctggtgagatctctgacgagtatttgagacgaacatggtgaggacatccacggtaaatttttgacgatcgccgtcgtttgacccccaatttcttgatgggagggagagaggagagatctcctccttaaatagggccggaggagaattttatagaggtcttcctagggttcttagtagccctaggagtcctcctcccaatcggacatggggaagaagaagaagactccaacgggggtcttcttctagaatttttttttctcatatgggcttgattcagggcccaattgggtcgggtcttacattctcctccttcaaataatttcatcctcaaaattaatttatgttatttgagatacgtgcttaaaaaaatatatacttgcatcatgtcattttcatgcatccgataatgtcttatgatcttgttataacaaaaattatttgaaatctcaaactcatcccttcttattgatttcttaacctttttaaagaattgtaacattttgatcttatattaaaatatcctagttatttatctaatacattccactcaaagtttataattgtctcagactacctatgatgtaaaaataaagaaaggtcgaatattggacactcttcacaatcatcgatttctttcttctcttgaccttccaattaatttaatagatagactttcatcttaagaaaatctcaatcttctatattagttcaagtaacaatattaaatttaaaaaaatatgagatctgtatcaagacattctaagtttgaactaataacagaactatcaagctgttaataaacttgagatatctaagatttcttggcattatctataatgaagcaacctactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacgggaccacctccgatcatcttttccgacatcctctcctccttcccccactagatcttctcccgatgcctccctgtaaagcatccacacggcgatttatagcctccatggccagatctcaggctccggcctcaccttcagttttctagtctcctcctcctcctccggcaacgatggttggcacgaaataattcgacctactggcccagcaggtcagaggtctcgctgaagcggtgcaggccatgcagcagcagcaacgatcgcagatatcagtgcgactggagagaacatcgctggaactccaaaatccgacgataggacgggccacttgggccagccaccccatctttcccgaaaagatgaatccgagggtggagaaccctcagtcagatcacgactccacccctgaaagatctctacctccattctgtcagaagaccctcgagacccgtagtcgagaggattttctagaccggaggctccaagagataaaccgatgaatcgaaaaactctgccacgctccccccgcttatggtgaggatatttgtactgaccctctcttttctcaaatgatcatgcaggaaccgatccgccaaacttcaagctccctcaatttgaaagctatgatggaactttggacccagttgaccacctagaggccttccggacaatgatgctgcttcatggtgtgcccgacaccatcctatgccgagcttttccatccaccttgaagggagcggtgagaaactggtactcggtgctgaagtcgggtaccatcttttcctttgatcagatgagccaccaatttatggctcattttgttagcagccggcatctccagaagggttcgaagtccctcatcaacatcaagcagagggagggggagtccattcgggcttacgtcaaccgtttcaatgtcgctgcattggaggtccaaaacttggaccaatcgatcgcgatagccgctctgaaaggcggcctttagaagaacgatcttttattctccctgaaaaagaagtaccccagagatttagcggatctgttggctcgagccgaagggtacgcccgagcaaaagaagccttcaaaatgaaggatgaggagaccgcgagagaacgacaagcaggagactcgagtaagcccgcagtcgaaaaagggtcgagagaagctcggccacgttctcaaactcctcccgggcacaagcacacctagactcctccccgagcacgcaggcagagaagcccgaagcgtcaggttcggtggggctctcccccaggaacattccgtagctatgcccccctcaacgcatcgaaaatccaggtgctgatggaagtcagagagcagctcccaaggccagaaaagatgcgcacgtaccttgagaagcacaatcctaataagttctacctctaccatcgtgaccacggccatgacacagaagaatgcattcaactctgggacgagatcgaggagctcatcagacgaggtcggctcgacaagttcattcagtgccgacctgagggtagagaagatcggccaagggccctgccacaacctgagccaccaagaagggaagagcagcccggggatcgacttccaattgggatcatcaactccatctctggaggaccttgatggggagcagaccttctacaaccctgagattcgaaaaatctgtagatgtattgcgaacgacttcgctttaaatcaagattcctttcagatttgcatatcctccccttttggcatggacttgtaatggcaggggataaccccttcagacaatgaaaataacacctaatatgggtgaaatcgaaggcccgattatttttagatcggatggggggagaggccctacagcgcccatacgcgcccccacagccatgttagggacaggaggagaacttcatcctaacatgagcaaggtcgaaggcccgattatttttagaccggatggggggagaggccctacagcgcccatacgcgcccctacagccatgttagggataggaggagaacctcgccctaacatgagcaagatcaaaggcctgattatttttagaccggatggggggagaggccctacagtgcccatatgcgcccccacagccatgttagggataggaggagaacctcaccctaacatgagcaaagtcgaaggcccggttactctgagatcggatgggaggagaggctctgcaacgcccatacgtgcccccacaaccctattaggagcggggaaagaacctcatcctaatctgagctgagatcgattacatcagaagtaagggaagaacatcgtcctggcgtcgactaaggtccgatcattcaagatcaaatcagaaaaagggaaccttctcagcggccccttcacgctcccgcgaccccactaagagcagagggaaaaccctcactcaaaaaaagaaaaaaaaggggaggggaggggagttaaaaaggaaagcgacgaactgcatcagcgacgaatggaaaacaaattacatcaaagatgcaggaaacctcgtctcagcgaggattggggttcttatcaaaatcctcgatcttcaagaaagctctcaacacaggccagggataagacggcttcctcagggcaacgagaagctcggacctccgagctcgaactctgaaaggaggcgtcaaacccgagcggccccggataaatctgcgaccatgaacaaaaggacagatcgatgcgacggcaatcgggtacctccgaacggcatcgatatcgaccaaggcaaaagaagctcggcaaacgataattcaacatgcaagtaaaagaggtaacgaaaaattctcttctcatgtcattaattaagtatacattacagagctcttgaggctgaagaagaaagatgacaagaaaagcaagccgacgcggcgatgaccaagaacctccagacgatatcgacatcaaaaaaaaaaaacaacaacaacaacaacaaacaaacagatggcaaaagaagatacatagaaggacaaaaggcaaaaaaagccctaagggggcccgacttcctccgactttgaactttcggcttcgaccctcattagagagtgccttaagctctcgacttcctcttccaattccttctccctcattagcatcttcatatatctccgatgaagccgctggctttcgttctccacctctcggcatttctttctcaggacctcggattctgcctctgcattcttgattgcctgctgctcgtataccagctagatcttcaattgctgcagcttggccttcccctccccaagggcgacagatagctcttctacggttcttctcaaggattggagttcgtcgggatcccgaacaggagcaaacggagctccttcagataactgccttcgaagacgggcaatctcatcggtcgccatcctgagcttccccctataatcgtccacctgcttgcaccagccggcccggcatgcgttatagctcacctcgatatcctggagctattgctgaaggtcagagaacttcctcgaccattctcgatcacagtcggcccgagtcgaaagccaagacgagcttccttccaaccggctgatcctctcctgtgcagccgacagctccactctgagagagctgatcttggcagcttgagcccaagatcggtcactggcgcacttcttgtgttcctctagctccttctcgaagttcgccttgctccggctgtactccatgatccccttcacgtggaggttccaaaagtaggtggcctccgtagtggcctcaaagtggctctccctcaacccgtgaagttcgttctccatctccttcgaccttttttttaaatgataaacttttttcttcagacattggatcgtggacttcagcaaaattccctgtggcaaggaaagcacttcagcaggacactgccaccggaagacaaaagcgtcaaggcgcgtctcattgcagagagaaaaaaaaaggggagaagagtggagaagccctccataaggagaaacctaattttattgattgaatatttcttaaagataaaagggaaaaaaaaattgcaataaaaaaaaatacaaagtcagaggtctcagacctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctccaccgctagaaccctggcctccgagatcagaaccgaaatttgctccatcaaatttgtgacctcggcctccgccttcctcaccatctcctccgaggtctgcttttctttctcaagggcctcttggaggttggctacctcgacagccttttctttgaggtgagcgacttcagcccggcgactctcctctgcctggatggcatccctccttacctggttcgtcgcctcgatattggcaaggagctggtgcccgatctacaaggacggccaggaggtcagaatgaaagttgaagaattaattaaacgaaagagtgaggaggaggaaagtgaacctgtttacctcgagaaaggaccctagagagtcccaaacccgctgttcaggatcggcgcgaacaatcctctggacgacttcgagcaggatgcagccatcgaccagtcactttatcaggtccttgtcattaaaaggattctcccccggctcttcttcgaaaccatgggactcttcgatggcggcccgatggctgctcaccctgtgggccaccgtcttccttctcctccccctctcaacccctggcacctcctcgaagcgggcccccgaagtggaaacctcagcgggagaactccttgaagagacccggagagccgggggctcagcgtctgaaggaacgtcgatcacgagggccacctgggcaggcgtggtcgagctcatctccttcgttctggccttctttatcgatctgaaggtcgctgcgccttttcttttgtgagccttgaagcccctgaagagtatccgtgctgcttcggcgtctatttctaaaaaaaaaaaagaaaaaaaagaagagagagaaaaagagatcagtaatggagtgaaaaaggaagaagtgacgtgcaaaaaaaaataaaagagagagagaggaagagcaggagaaaagaagaggaaagaaaagatgggatactcgcaggatccaaggggctcaagccgatgttgaacaaaaactgctccttcagaaggttgggaagggaaggagtcgaataactaagaagctttcgagcggccttaaggtcgtcctcccctaggttgggggcccgacggacagagtccctcaaggagccccaaggaggcagtcccagcttcaaggtcgggcactggacgtagaggtactttcccttccaattatggattgaagagggggcacccttcagtaaccccttcttgccgaactgagaggagaagtaccactagtcctttaccgaggggtggcacttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaactttcaggcggaaggagactcctgaaggtggaagggcgggtttaaataaaccctgggatccagcgctataatgatcgtggatctccccaggccgacccactctcgccacgtgtcccactcgccacgacaggtggctaaaagcggctgacagctgacaaagccattactgtaccgtacctgagccaacgctccagcgagaatttcgaaagatcccttcggatcacctcgatttgaaaagactccggcacgcgcgcattaaatgtcagaatatctgagggcgatcgtgcacaggattcaaggggacaacttcggctatgaaaatttctctgtacttttttcattcgaaactcaaactcgaaagtaggaggactgttgttgggtataaaataccccccagtcgaagttcgtgacaggagtgaccctccaaggattctaccgaccttcgacgacatcttttcgagcctctccgacggtcgagcctccacaacattctcaagttctgccgacggataaactcccaccagcgtcgatcgaattcttcacgacagacggactccacccaagtttctacctgctagtcgtcatccggactcctacgggagccggacttcatccccgactccgactgcaggcagacttcatccggactcctacgggagccggacttcatccccgactacggctgcaggaagacttcatccagactcctacgggagccggacttcatccctgactccgactgcaggaagacttcattcggactcctacgggagtcggacttcgtccctgactctggctgcaggaagacctcattcggactcctacgggagccggacttcgttcccgactccgactgcaggaagacttcatccggactcctacgggagccggacttcgtccccgacttcgactgcaggaagacttcatcaggactcctatgggagctggacttcgtccccgactccgactacaggtagacttcatccgaactcctacaggagccgaacttcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaattttcattcgagcactccattcttgttgaggcagagaactgacttgagcatcgaagggtcttatcggagcaccccaactccgatttagactttctttgcaggtctcgatggtgaccgcggctccctcgactccagcttctccgacgccggtggatttttgcaccaacaatattgttgttaaattaaatatgaagaattagttttgttagaatatgatatacatattatgaaaaaatctttaataattcatattaccatctttggattggatttcttaattttgcttatgattgttgaagatagtggagtgtattaattaatcaaatcaaagtttagatttctaagttgatctaaggtatcttgttattgttaaattttgaatgacttatataagggataagattttgtatggatttatctattgatgctaagggttgtgatgaaggaagttttataagaaataactaagttacttctacttacaaagatattgacttgaattcttctagtttgttcaagtcggagttaattcttttataaaaaaaattggtttaaaaattatctaaataattgtaagataaatctaaggttaactccaattaattctagacatattggattcttgaggagtggtgaagcttatataatgatttcaaatatagaaaatagatgaagatttaattttattgtgctatgccccagggatagtaaagacaaaaaaaaaatttaaaattttactataagttttatatgaaatctgaaggttggatctatctttaattgatctaatatacaaagatactcttatcttttgataaacctatataatttgataaattaagatcagagtatgcagtaaaagcttagtggtttaaattgattagaaatattaatcttttaaatcaaaatatattatggaatgcattagttgcaaataagaaaagattttattgataatgaaaggatgctacagattttgacctaatctgatcatagacggataatttttatcagtaggttattttattatagataatgtcaagaagaactctagacatctcaagtttattattgacagcttgatagttcttttgttagttcaaacctagaatgttttgacatagatctcattttttgagatttaacattattatttgaactgacagagaaggttgaggttttcttgagatgaaagtctatatataaaatttgttgaaaggtcaaaaaaagaaagaaattgatgattatgaagagtaagtacatgatgtttggcctttctttacttcctatcatagatagtctgagataattataaattctgagtagaatgtattagataaataattatggtatattaatacaaatccaaaatattactattttttaaaaaagttaaaaaatcaatataaaagaaaaaaatttgagatttcatataattttgttaaatcaagggaaataaataatatgtaagatattattgaaagtgtgagaatgacatgatgaatgtatttttttttttaagaatagatctcaaataacacaacttaattttgaggataaaattattttaaggaaagaaaaatgtaatacccagcccatttgggccctagaccaagcccaaaccttgaaagcccccccaaaaaaaaagaggaagaacattgaagactctcactgggagtcttcttccatgagaatgaatcggagaggaagtcgaattcggagaggattcggcctcccctctgctccataaaaaatcccctctcttctcctctaaggctggccatgacgagcattggatctcccctcttatttttctcgatttttcccgttgaagtcacggatgtcctcattgtgtttgtctcaaattctcatagaagacctcaccagagtcggaggtaagccatgaccatccttcctatcttccttttcctccttcccatgggttcgtgcaccctcatcgaccgtcgggctcatcaaaaaattcacaaaacaacaagatcctattttactttattcgatcgagccttctttctcccttttctggccaccagcaccaccgcccatggtgccgcacccatgagtcatgatccccacctctctacccatcttctccgaaggtcatgatcatcggtgatcggccaatgactagaaaaattcaaggaaagggggtggtcccctatttttctaatttatttctaaattctcaccgactgaacctcaccgccagtcatctcttgtcccaccaccgtcagtcgccactaccggaccaccgaccgtgctaccacacttcattggagcacgagccaccaagccttaccctcatgtccctcctctgttcggctagggaaagaaagaagaggaaagaaagaagaaatgaagaagagaagaaaaagaaaagaaaaagaaggaaaaaaaagggaaaagaaaggaaaaagaaaaagaaagaaaagaaaagaaaaaaaataagagagagttttttctctctttcctctctcctctctctccttctctctctaggatctttctactctctttcattctctctctaattgcatcacagatcctaagacaaacttgagatgaaaataagatgacttggaatcgcttcaaaatttatgtagtaagttggatcctagtccagtccttattcgaaatttatagtatctgatcatagttaatctatattgagtcaccttgatatgatctctgatggtctcgatcatgattacctcatctgaaggatacaaagattctctctctactttctctctctaaaattttctctctcttcatggattttctttctctaaaagtcttatggatcagtggagggtccagatacttagacaaatcctaattttggttgatcttaagagaggtcctggatttatgttattaggatcatttatccataatttttttatatatgatttttatatttgatcaggatcatgaagagatacgactgtctgcataagatgtcgagtgaaatatcttatttttgtaattcataaatcaaagaattcattgatttctatgcttggatcaatcatcgataaaggtaagaatctctatatatgatcatcattatatatactatttttattgttggatttatatctttggttttatatcgttggattcatgttgatggattatcatgttgagatactatggttgctcgtatgatttttcaatgtacatatattatgtattaatatgtatgtatgccagtgattgatgatatgattatatagatatgacatatctaatttgatcatactgtaaattaaaattgatttgatgaaattaatatgtaataattaaataaaaaagatatgatttggactagcctcatcatgtgggatagcctgtcaggagcttatgcctgagacagcccccacgggcttatacgtggatcagacgatcaggagctcatgtctgggacagcccgccaagagctcatacctgggacagcttgccaggagctcatgcctgggatagcccctcacggacttttatacgtgggacagctggccaagagctcatgcctaggatagctttgaaaggcttattagtaaaaatttgattgaatgaagaatgaggtatagacttggttagtccaaagccagaaagaaaaaagttaaagatcatgtgattatgaaaagagaaatagaagacaagacataaaacaaatgctgaataaaagtgtttcactcgttaatatatgatgatgcatctctttgacaagacagataatttatgaatatttgtagtattctggatattgaacatgagattttatattttattatttatccttatttttatattatattattatattggtgtgatatgtgggattcttactgagctgtaaagctcacactcctccatatctctttttcttctcagagttacaagatgcttatggttggctatgatatgaatttacaagtggatggatgcatagatagagtgtcattgatacctgatcagagaattgaaagaatttaatttataattatataagttttactaattatgattgaaattagacattatgaatgttgaggtgataatgaattatttttagccttgcatattctttagggcttgtcctaaggagtgtgcggccatcacgtatctgatccaagtattgggtttggggtgtgacaccatcaaagtctaaatcgagagaaattattgcctagaccacgcccaggcaaaccacttaaatcccatgctggataacacaccacagcaatccttgtatttcacgaatccagacatcatgagtggtatggatggataggccggaatcgtctcccatcattttcttcttatagctctcacctctctataaatagaggtaaaaaagggatccttcagatacgcatactcgcaccctctaaccctctcacacttcttctctcctattccagtttcttaacttaactgttagagggtctccactaaagccaactctaactaggacttattttgtaggtctcaccatgtcggtgactcccaatggactccaaccactccaactagagctgaaaatttacaccaacagttgatgctagaaggagggcacccacttttgagaaggaacgagagatccaaaccatggcaccatgcaaagaagtatcctcccattgttccaatgctgccaactctcgattggtagaaaattttaccaatcaacaagctcaggtgccgccatctttagaggctccatccctgcaagaaatggtggtcaatgtggagcagttcaacttactgggccagcaagtccaaaatttgactgctgctattcaaactatacagcagagcaattctgcaccactgactgctttactgctagaacaacttcatatccctcacgaggcccttagttggggggacaggctcggcatagccacccccaagtgccagagtgcaggatgcagcgattctaaagttctcactctaaacatgacttcatcctaggcctatattcagaagcctgtaccatttgagatgtggaaattgaccacagactttgggagatgaatcagtggattgaagcccttcgtaaccaggccccgatgtgagatgatggctacaatactgatccactattcagcatctaaattatgcagaaatcgctcccaatcacttcaaaatgctgcaactggagagctatgacgagatcaccgatcccatggatcacttggagagcttcaaagctatgatgtttctccacagagttgccgatgctgtcctgtgtcgaatctttccatccactctaaagggtatggctcagcattggtattggagcctgaagctcagagccatccactcatttgactagatgagttacttattcatgactcatttcatcaatagcaggaggcaatgtaagggatcgaattcgttggccaacatcaagtagaaggagggcctaatcctcatctaaggaaaacacccccacttcctcatcactgtttccaaggtgaaggtggtgtaggtccagcagcggcattggatactttatgtgggctttacaaatctcaaagtcctaaataaatctagctaccgaagcatcaaggagctcccccttgaaggctttggaggccttgtactccatgatgcagtggagtcgcacctcaacaaatacatcgatggtcgtgccccgatgggtgctcccccatgagtggaggacccctttcttggggccctcggaggaggtggcactcgacctgcactcagagactctgataaggcggccttcatcctctcgggtaaagacttccttaggtattccaccttcttcttcactgcttcctttacaagtcatggcgatggctccatcattgtaaattactcaaagaagattagtggaagctctctgatggatgccctactcgagggagacttcctatttatacaggtatcgagtggcgcatgcccaaccaaccagtaatcaaattgcgccacgcatctgatcttgaaataccaatcatcatagccattaattgccacctttcattatcaagaagtagccaacgaaatgcttcgagacccacttcgacccaccacgtggcactcagggatcgacttgggacaaatccctagccttttccctcagaaagtcctatttgccattgtggcggatggagtttcaaggtgcatcacgggctagtgcttgggttcccgatgagtgaatctatggatcaactttgaccaatatagagtcaactatcaggactcctcgaacttatcttgagaaaactttagattcacccactgaaagtcttcagattggatgaaccttaaccaaggccatagaaatccacgccagagaatcttgaggtgtattattaatgatgtattgattatctttcaataaaatgatcctttttcaggacacagccgtgcttctgccaatctttggtgaagacctcggtagctaagaagcgagggctaacccactgaggacccttgactccttgctctttagtgagtagaacaccagaagaccttagccatacgagaagtgaaggctaacctagtgagaaccctcgaaggttcctcattctttaatgagtagtggcattgaagatctcagtgactaaaaagtgagggctaacttattgaggaccctcgactcctcactcttcagcaagtagagcatcagaagaccttagtcgcacaagaaatgaaggctaacccattgagaacctttagagagtggctaacctaaaatctgagtacccatcaatccaagctacaaaagttgaagacctcaatgactaagaagcaaggattaacccacttaggaccctcgactcctcacttttcagtgagtagagcatcagaagactttagtcatgagagaagcaaaggctaacccactgaagacctttagagggcaaacctgtgaggaccctcaacccatcaactcaaattgcagaagaaacgacaactaactcaaaaaggaccttcgaaaggcttatctacaaggaccttactttaaggctatctatctaaatagtatgggttaaagatctcgatgactaagaagtgagggttaacccattgaggactcttgactcctcacttttcaacgagtagagcaccagaagaccttagtcgtgtgataagcaaaggctaacccaaaagaacattcggagggctaacccataaggaccttcaaagcccaccaacacaagctatgcgagaagcgagagttaacctctaaggactctcgaaacaaggttgaagacaaaagcccacccatgaggactcttgagttcaaagctaaagctaacacacaaaaacccctgtggatccccaagtacgaagcctaaacatacccaagttcagattgcatgggtataagaaaactgaaataataaacataggtgaaaccgaaaaactttgatttgaaagtatttcatctataagcttatctaattatagacgtcaagacatgaaaaacaagcgactacacacacaaaaaaaggaaaaaatacatcattttttggtcggtggagtcttgacgtgctacgaagctaaagcatcctcgatagctaggcattccaaaccagtgtcaccaacattagatatctcaatgaggttgatgtctacttcggggaagaattgggcgactagagttctacattcaccaaaaccagctttgaaggcctccatagatgtcttcctgatctggaaggtcacctcacatcgggtagtagcaagcagggactccaggcgtttaactttacctttggtgaatctacctactagtacactcccctctagtttaatccgaagctccaccatcttcaatctttctttattcatggtctaaagtaagttcactctgaagttcagtgactgttgaccactatttttttatcgaccagtcaagatcatcgattgtccctgagccgaatggagctcaccttgaagttgacttattttggtagccgaagcccacttggcttctttagcaatctcgaataatgcaatggcatactccaactcgaagatcttatcttgagtgcgatgaagctcctcttgataaagagctacccttgcagccgcaccccatctgacttcattggccacccaaacaagcctatctcactctttggacaccttgcgcctctccatgagatgcttcttgtgagtctgcttggagcacaccctcaaacaatttatctcaaccaaagcctcatcatatttcttcttcatcctcaagaacttctgcccagctttggctgcttcttttctgtccttcttaatatctttttcaagggccttgactcgaggttggattggcaaggctgtcattacggatgaagattcggcacagtacttacatcagtcaaactaagataaacaagtcacaataattatgagtcgaaggaggaggtaaaaactatctttttcattaatataaaaatattccttacatcaacaagaaaataaaaaaaaattataaaatttaagtatctacgacctcggcctgaggaccaatgaagaaacttagagcagcttcggtgggtttcaatggtgtagaagttttggctatggtagatgctggcacatcccctagcactaggccagaccatggccattctctagcggatgtaaaaccaaaggctggatcttccgtggctccttcttcttcttcttcctcttcctccccttccccttagtccaggaaggctaggttaaggtctggaaagcatgctacaatctttctgtgatagttattctgtccggtgccgtaggcttcgtggtcgaactctaccttcgtctgaagaattcctccaactcccagaaggcttcaatcgcccgatgcccagcctcagcaatctggctctccacctttttcttggcctccgcaacctttgcctgggccgtccatcacttcttcttctctgaggctaggtcagattcggcttttgccttggtagcttcggccttgtccagcacctctttcaggtgcttggcttcggcttcaacggctttaatcttggatcgtgtttcggctgcaacagcttttggctttttctccacctcgatagcctccaactcagggatcctcaatgagttgatgaaggtggtgacgtgatggcctagctgtgcccaaaaaagagaagcaaagatgaaacaagagaagaaaagagttgaaagagaagagaagaaagtggactcactcgaatgaaggaggtaacggcctccctctgtcatcttccgatgcttagctcctcgattttgtctagatcaatgctaatgagcatcctctcgattgcacgatgggcaatcttctagtcctcgaggatcgcatccatgggaaatgaggattgggcttccctttgcctaataggcacttcaacagagtttagacttgactgatcagcccgaatagaggtctcttttagcctagaggtagggagagcagccagcatcaaagggcaagattggatcggaggagccgatatagcttctacctaagtggaggaagctgaagggagcacctctccctgattggtttcggagggccttggcttcttctaggccatgatagcagctaatgagaatgctttccttttcttttgtgcattcttcctcctcaacgcctcaagctctgcaggcctcatatctacaataagccagaataagttaaaaaaaaagtgagagagaaaaaaggaggtgaacattataagactattaaattgatctctggggtcggtcggattgagaccagtatggaagagaatctgcttcttgtactcccataaaattttggaatgttctatatcctctccctctaacttcgagacctaaaaaatagaatccctcgactaaccccaatagaaaagcctaagactctcgatggaagggtctgaaatagataaaaatcgatccttccacccatgaaccaaagaaggagcctcctttatcaatgcagtgaccctcctaagaggagagacgtaccatcaatctcaggtactctttttatagtgtaaaaagatcgaaagagaggaatcgatggtcagacttcgaccagaatgcagacgacaatgaagctaatgatgaagtggaaggaatttgggatgatagaaaaaagaaagacattgaagaagcaaaaaatttctacaataaaaggatgaataggcaatctaaatctagccttaaatacctcttcatacaggccgattctattgagggaggatcaccgatcctatcactggattctagagtctctaactcatatgaagatagaatctcgtactaggcccttataagatccagatttcttgagtccaacatggatccaattgtgtcgggcacaaaaggtggtccaccctcatgcccaacaccagaatcgatggaatttctccccaaagaagagggggacttggaagactaactctcactaaaaccctcagaaccagccattgaaggataaaaggaggaaaaagagagagaagaaggaatgaaggaaacaaagaaagggataagaaaaattgacagagaaccaaaaaagggagaaatcaaaaaactgacaagagaacaaaggaactcaccaatgacgatgcgggaggcgaggacaattgatcgaggaaagtcactggaggaggttactagcaacccaagaaaattgagggagaagccggagggggagcttctcaaagaacttggaggaagccaaaaacttggtcaaagagaaagaaaaaactctggaagcataagagaagccagaaagaaaatgtggccccttcttataggtgtagaaaggccagtatgatctggataccgaatccttctaactgttggatggttgacatctggcgcaccctgttggccaacagaagccgacagacagctcatttatagataacactcagaacaaagcacgttgtcttttgaatcccacaaaatcgctctatttttctcaatcatgattaacttctgacatgatccttcctttcttcaaaaaggcacagacgcatcatttcagccgtgacaggagcatgtcttcagagccacagatcaacgtactcccttcatttgaatcctcttcgattcgaactcaggagccagaggcatgtgttggagggtagtatgtcgcctacgttgaagatatgtgatagtggggatctcactttggatctatccgatctccactctccaaggtcgccaccatagtgccgatcggaggtaaatgagtacaacctagtgatagatatgtcatctcaaaactgcagtaaaagctatggtgaaggaagtcatctaatatataatgaagcaatggactttacttcggatctcaccgatccatactatttcactgcccctttcggatgaagctcccgcaatagttggtggaaaatctgatcgatcttgacttcggctgtcaacctttgcttcgatcgctaatcctagcttcgaccgctaagcttggctttggctgtcaattgtagccccgctcacaggtccttagacgctagcatcaggatgatgtctagacatcgaacatcaatctaagaaagatgctgagcccagtatcgtctttgatcgaaggatcccctgctaatccccattgctagctgcatgctacattcccttcaacacttgttagctaccatgtttggaagagttaactcccatgctgtcacatcaagtcacaccactgcacatgggaccataccactccaacagctaactacgtgccgagtgaggccacatcaaaatcaagctgcccctaagagtggctaactgcatgttgaataagatgacatccggcgtcaaaatccaaattggaaggaattattacctggaccccgcctaggcaagccattgaaatcccacgatggataacacaccacagtaatccttgtatttcaaggatccggacattatgagtggtacagacggagaggccgaaatggtctttcattatttttttctcttatgactctcacttccctataaatagagataaaaaagagactctccaagtatgcatactcatgccctctaaccctctcgcactcttctcctattttagtttccttacttgaccgtcggaggatctttcttgaagctaactccggctagaatttattttgcaagtctcgccctaccagtgactctagccactctgactagagttggaaacctgcagcaacaatatccaaaactagcaaaccattgctgaaaacgtctgatttagtggagaagtgcccatgcttatcatattcaggagccatatatccattgccataaagaatttgacgatatcagattttctgtgcgaacagatactgatgattcaggtcaaagatcggaataataattggttggatttttttctttttttcactaattaagagaaggcactgatgcggctgtgcttactgtgttcccgcaattcggctagtgttttgcttgcgaatgggagacgttgtttccaaagtttctgattctggacgtggctgaagagcacggagcagaagaaaacagcggatttaacgggagcggtggcggatttgactggaattgaggctacattcgtttgagaccactttgggggcatctgattttctgatagcgccactttgaacatagaaattaaacaggcactgaagggcttggaagaggaacagagttaccatggagcatgagaacgactgaagccaagctgggtctctttgctggatctgcttggacgcatagaagcccaatgtcaaagcatcctagtacttcttgcaattgacaccaatcacagagactttggtcggtcacctgtgatgccattccttcactccattgttgccacacctgcgtataattgctttaaaggagtcaaataacacaacttgtatagccaatgcaattagaggattccgctaaatataatgtgcattagattgttaataatcaagctttaggaggatgaatgcttacgtggcttggaagatccattgcatgccctgatccttcaaaaccactgttcctttgaccagtcactatctctaaaactaatacaccgtaactcaatacatctgacttggtagaaaagtgcccatgcttaacatattccggtgccatgtggccactgccacgaaggaaatacagcgtataagctccattgttggacacatatgatggaagttaaagacaggagtgccgaataaatttgtttattcttatgctttcatcatgtgtttcccatctttgcatcagaacaaagaaaaaattattcagccccgtacttactatgtgccagcaatttggcgagtgctttcatgggtttcattcatgccaaaaaatctttgcgagaccaaagtctgaaattttagggttcatgtctccatctagcaaaatgttacttgcttttagatctcgatgaacgatcctcggtcgtgaatcttcatcaagatagaaaagcctgtgaccagttcttttgacgatcctgcaccgaacttccaatcccagttgctctcgtctgatgggatctgttgaaacaaagtcgagttggccaatggaaggaccaatgaggctacaccatctataagtagattttgcaccatatccagatgtactataaccatttatgtatcgccgaaaatggtaaaggctgtttgaatacagagctcttcattaaaagaaagaatggatatctacacaagaactattattaaataaggctgcagtgacaatagtaacgttgagtataaatcattgttacattaagaaacaattcttcgttgttagatgtcatgcctgatagatggaagaaatggaaattacagactactctaaactgttcaagaatatacaccactgaattgaatgcaataaggtcaacatggacatcctcgagctgacaaaatttttaaataacatgcatttaaggtggcataccgggctagtgacaaatataaacccactggttgacatttacgatagtcgttcctttttcttttcaaaatctttcgagcaaaagatgatatagtaattcttaagatagggtttgccctgaaaggaaaatctaatataaagatgcagtcgtgtaatggagcatatcaaataaacatttgtcaagattttgtcaggaagatgctctcctttttttccccccttttagctgtaatgggaggctcaaaaacagagccacccagcttcattccaaagaaacaaaaaaacagagagagcaaaggttacagtgtactcagggagtgtgaagagttacaggtgtagagattcagaaccttgtgagggagttacaggagcctaagagaaagaggcagacatattcatacagcctaacagagaagaacgaggatattaaagtcaggaagatacttatatgcaagatgtttctcttacacttctaagcaataaccagcaaatttacaaggtctctgtgccagatcatagcgaccaaaccaacctcatttcttagctgttctagtccttgccctaagcttattgacacccactttgcagctatcatttgtccgtctggtagtcttccttttatttcatttatacaatacagtgaagaagttaatattttagtcaaattgattttcgatatctttgcatttgtcgaggtaaaaatgccaatccttaagaatcaatctgggggatgccttataaactagcccaaatcctccttttccgggtttgtttgcatcagagtagttatttgtcgcagctcttagggtttccaaatcaaatactggagactctgcacttctgatctccttccatctccaacgtccgctcttgtttaagatacatgtagtcaaactatgcattcctttgatgcaacacgagttttaagtaaatctaataattcttcaaaatacatacacggtggttttctagcttgtttccgttgtcgtaagtaaatgcagatggcagagactagcaacaccaccacagctatggttatcacagtgacaacaactattttgctcatgttgccagtatttcccggatcaaaatgagagaaaaccacttaaaatcatcatgcatatcaacacacacttgtaatgttcaattagtctcacctaacagtgggtggcaaatattggtgatttgtaatagcctatatttttttatttgttaaaaataattctctgcctatagggataattaaggcgtattttcgtcttaaaaggtaccatttgggaacaactggatcaatcctgttggatctctgagaatcagaaccaaccaagcaagcccggcccacattaaccaaaccgtcctacacgcaattcatttagccaggcacatccaaacagacctgaaagttgattagatccctgtatcagtgtatctagtcttttccttacgaaaaattcattgattgacttgactgacaccgtctttggatttgcctttcctcattttggtcatttttaacaactcaataggcctggatttcgtagttgacgcgttaataagacgttgagaggaagaaagaaacaaaggatgatggtgatggaacatgacaaattccaaagtgacaaatagttgtaggccattatcccgagagacatggggctcccaagaatccatcatttgcggtcaccagccccgtattgaccgcaaataataaatactcagtcatttgccttattctaggagcggtttactggcggcctatattgaccgcaaataatgttaaaaatatccgattgtatcaactgtactaaggcaataaataatgctcaagttcactaagtatattatattgatatattggtttcaatcacagtcacaattttcaaataagaacaaataaataacaaagtatgatttaagagatccatcatccatgaggtctttacattgagtggcaggtctatctgttttgcgaaacaaaaaaagaaatgaaagaaaaacgaaaagaaaaatatccagcctttcgacgtcaaaacaagtataaatcatgaaccaagcaacattatagttctatcctagttaaatttggatttcgcaaattataatttgatccctatgttttggcatggtaaaactacatgcctatatataagcagccaggaatttttccaatatagcacttgttaaggagaaatgcgcctctcacatttacgagatagtgaacataacttgttaaagtttagtcctgccaatatagtctagataaatcagcaaaacaaaaaacatggtctatatgctattagctggatcccatatatttatacgcccaatttttcaaacataatgagcaggtgctttatctaaatatagtccagataacattaggttgcccatcaaactgtataacgcttgtaatactaatacattactcccaatgaagaaggatggtcccttatttattacatctcagtggataacaaatcaagttccaagctgccatctctgtaaagttaccacagaattaccatatcatgccatcctctggatgatatccagaacagaccatatctatcaaacaatacaattcgcattgaaattgaatccatattcaccaaaaatattcaaatcaactattgttcaaagatgtctatcaatctcacacctctatcgcggttccatgtcagtgattgagacaccattcacagagattggccttgattttcttgttgtgcttgcattggagctctcacttcctgataaaccagtcctcacgtccctctcgagcacagctgactcactgattgtaccacctcttataaagaaggcaggtgccaatggagctggaagagtgacagagtaacttctgagcatgaggatgactgttgccatgctaggtctctccaccaactcttcctggacgcagagtagccctatgtgaatgcaccttagtacttcttgggcttgatagtgattacctagagttgggtctatgacctgtaatgccactccttcattccagtgttgccagacctattcaaagaataggtttagaggatttcaaaatgctaacatgataagaggatactgaaagctgtggatcaacccttttttttctttcttttttggttcggtgggtgggggggcggtgttggtgggggaagaatgcttacataggtaagaagatctgaaaaatacccagatccctggtatccacaattcctccggccagtcacaatctccaaaactagtacgccataactgaaaacatctgatttggtggagaagtgcccatgcaaggcatattctggtgccatatacccactgccatacagaaattgagaagatattagatttttctccatgaagacatacttatgattaaagtcagatatcaaaacagtaatagactggacatctttctgctaattattcagaaaagaaaattaaaaaagtagatgcttactatgtcccagcaattcgactagtgtttcctcgggtctcgtctatgccaaaaagctttgcaagaccgaagtctgaaattttaggattcatgcgcccatccagcaagatattagctgcttttagatcccgatgaatgatccttaatcgtgaatcttcatgaagatagagaagcccacgtccaatcccttcaataatcttataccgacttccccagtctagttgttgtcgtccaatgggatctatttcatccaagtaaacttgataaattgaactgatatcgtaatgtataaccggtacatttaggctattgaatcaatatgatgttagaaatattaagggcctatttggatggttggatccaaaatcgtatgagattcatggaccaagcataaaaaatattgaattataagtaggtcaggtcctatatttataagtatctaggatcatttttgagtgggctggcccgaatcccataagaagaaaaaaataacctcagcaggtcatttttttctccctatgcgatttgggccagcccattcaaaaagtgattctgaatacttgtaaacaaatggcctgacctgcttataatccattattttttatgtttgggccacagatcccataggattttgggcccaaccaaccaaacatgccctaagcagttatatcatgggtggcctagcctcccttaaatcaaaaaaaaaaaaaaagctgcgatatgatgaatatttaccacaaaattgcatggagaaaaatgctttagcatgcaaaaatgatgccatcatcatagagtcatcttaataaattgacacaatataagaaatcaggttacgcaaaatgatggcattcgcatctaaccatatatgcaaggccagataacagctgaaacaaaaaaatccagagtaaagaagtatgttcaaggtaatgcaaagctaacttggattgaataaagactataaagcaacctcaaagtggtataacatctgtccagtgttgtaataggctagtaggaatatatacagcttagttcagtgaatagctcatcacaacagggttatataagttacaaacctgatgatgttcctatttgcttaaaaccaaggaaatactatgtcaatccttatgaaaaatatgaatgtagaaaatggagcataccaaataaaaatttatcaaggcttgtatttggaaggtactcatagacaagtaacctctcttgttcctctaggcaacaacccaacaacttaacaaggtttctatgttgaagcttggcaagcaaaacaacctcatttcttagctctactagtccttgccctgaacttcctgagagccttttcacagctatttcttgtccattccgtagagtcccctgtataagatttaagacataggaaagcaattactatttgtcaaatcaacaacaatgtccacaattccatgagcaaccatgaaaacctgtctagataattaccttgtaaactgctccaaacccaccttctcctagtttattggcatctgaaaagttatctgtggcagctctaaggatgcccaaatcaaataataatgattctgagcttctgaaatcctcctcaactccatcaactactcacaaaacaagcttaattacataaaaacccagcccattgtcctgaattggatttcttagaacaatgatgcagcaagaaagacttactgagtactcttctaaacactttccttctttgtaagcagatatagatggcaaaaaggaccacctgtgtagcaacgatagagacggcaacaattagaactacttttgtagtgctattaactttccctgcaccaaaagaaaatttagtaattagatccatcattttggcatggagatgtaaccaaggccaaatgaaactgcaaattgcctaccatacacacaaaagacccaaaacttaaattgcttattgtttagacgcaacctattttccttctaagaaatcaaaagtagcaacaaataagttggcttttgaagtttataaaccaaggtggactcttacaacctcaaagggaagttttatgccataactctagcaagtgcaacattggcatactaataatatgcaggaaaattgcctgtgaattattacatttgacagtgatattcagaggtgaatcatggatggggatagcatttactgtgctgcatgtttccaaaagctgtagtacatatgacgctgaatgtgtttctccggacctaagatttaaacttacaaaagaaattaaaaaaaataaaaataaaaagaagagattacagcagcataagccaccgacatgctaagtggtttgaaggaacaaaaacatagtcattattaaaactaaatttattggtatgcgaaacaaaagttcctttcatccaaaacaaaaaaaataaaaataaaaggcaaaaataaaaattccggttcaactgcagaaaaaatcgtggagtcttgcgattatctctatctaattatggaattcatcatctgaagttgattgaaagcacacatacttctaaagattaacttagcggaaaactaaaattcctatatagagttcatgacgaaggagtggaaaagctgaagatgtaatttgttgttaaagccaaccaaattaacagtataaccaatatggccccaaagacagaaattgtcttttcctgctttatccttatcggagttactagtcgtaacgtccaaatcaagaacaagtcagcacaatatccaccaaactcagcgttctgtttaactaaatcagtattgagggaggcattctacatcaaggggagaactatgcctaccaccacctgtcgtgtctgtgccattgccaccgtccagcgaagaactcgatcccggcggtggcggaggtgtggctagctgcggcggtggaggtggggccaccggcggcgccggagggaccaacgacaggggaaaaaagggatatagctcaaacctcacggcacaactcaccttcaagacctgtaccccgataggcccgatgcaacaggtgggcaaaaacccgatcgcacgattgagacagatggagcaatttgtctccgatagatcacgggtacactatgccatcccatatatgtacccatcttgcgaggaattcgtgatccccaccccaaacttggattccgccgctgccgcctgcgacgcgatctcgtccatcatattcctcatctgccgatcgaacaccgttggatccgacaccgttttggaattggcaatctgctggggcagttcgttttcgagctggccgaagaagcgttgatcggagtaacgaaggatgcagaggtcgaagcggatggcggcggacctgcggaggtggcagcgggtggcggcggccgaggcggagcggttgaggcaggtggaacagtcagaggcggagacgtcgggtcggcattgggcaaggccgtaggcgggggctgaggaggctgcgccgacggtggtgttggcgaagtagccggcgtcgcggggggaggaggtgaggttggagaggaggacgtctaggttggaggagaaggtgctggggaccgtgtagttggtgtcgccggggcagtaggtgaggatggggtcattctgggaataagttttggttggagctagaagcagagtatggaggattagcagagggaatagagacaagatggatgccatgaactgggaagaggagggaaacagtggaaagggagatgtcgtttgcacagcttctgatttggctggagagcatggtggaggacaaaacagcggatttgacgggactggccgcggtgacggatttgatggattttgaagttaaatttggaaaaacttttggttgcaacaggtccacgatatcatttttggactggttcaaccagtaatggacacatctacgaatattgggggaggtatagtttggagaaaaatccaaaagccccgcgccctccgacctccgcgggcacgatagaagtagcaactggacgtccagacgccaatcctctcaaatctgcgcgcgaccccttatatttcaccgattgccgattgcgcgctttccaccgtgcaccgtgcaccgtgcaccgtgcaccgtgcatatgcttcaggatttacctgattcacttgcatgtggtgcatgcaataaattctcctgcgaagggcctccgtattacatgcatcaaatgcaattggaccacgcaaatcccggataacacgccacgcgactcttgtatttcaccgtttctcaattgtgcacttttcatcgtacatgctttaagatttatcttgattgacttgcatctggtccatgcaataattttttcaaacaaaatggctccgcgatcaaaatccacgacggcctttttcccattcctttccctttggtcaaattttcttaatttttcttttcattttttttttcacataataccaaacctcccctacaaagttctaaatcccaagaggagaaaagaaaaaaaaggttattagaaaaaacagaataaaaagaaagagccgactagagaaaagtataatcatgattattttcttccatcaacgatttttttccctcatagacgtgcttttttttttttcggtaagaacctctcatagacgtgttgaattggtccaaaaatgatagtttttcatacattcgcttgagaccagttttagtgcatttaatttgctgatagtgccactttgacaatagaaaacaggcactaaagtcttgaaagaggaatagggttatcatcacgagtgaaaatgactgatgccattatcatgccccaaattccacgttcaggtcacacgatacaaccgcatattcctccaaattgtgaccctaaaatgtatgcaaagttgatattccttgagattatggccccaaattttgcaggacttttgtttagtgcaattctttattttggattgtattaataatgctattaataagattctttattttaagcaataagaagggctcttatttaaatattttttattatggatagtctattaataaataaattttatttttgatatatgaatgagatggacaaaagagaattggatttacagccacttcgatctcaccagatatcgcacctagccaaaccccttaaagtaatgtttttaatttaagtccgtgtcatgtagggaaaaaaaaaaaaagttggatctggtgaataatgatttataaaaatctctcaaaaaaactgatttaagaaaattaatttactgttcttttgtcctatggtaaatagtggttctttaataactttattcattttcaaaagtttttaggtcttggtaacccacaattattatttcctgtatcacagtaaatactgataacaaaggaggttcatgtaaaacatcagtgttcctggagccatatattagaatagttttaaggaaatactgataacatcattgggaattttattgaagatattcagttggggagaggcctcaactcaaatttacacatttgttactacccttctgggaatatgcattggacaagccttattgtaaaacatacctgcatcttctggagtaagctataaatgatgtttttttcacctttgaaatgactttttttcaaatcaagtctaatgatttttcatactgaagtcctctatgtagttaaataaacaactctaatgaaaacaagcaccaatatgttgttaacaaggggagggagcatggcaggagtatcctttttgcgcttttgatagccatgttcattggctaatttgatgccaaattggtaggacaagcatgatatatacggtcttggccgggaaagagacgaggagcagtttctgagcatggcatcctaaggcctatcccgccaattacgatgaccatccaattccccttaatctagtgatcttggagaggcctagttgtcggttagtctccattcctcgtcaaatagcaacaagtttggatggcttaaatctccaaatatgggaatctatccagccaggagcatatcctttttttttttgtttgtttcttttgatgaaatatgaatgaagtgaggaacttccccagagctttattagactacaagatgtttacagagcaagttagaaagggagaggtcacatagggaggagggcagttacaagcgcagggaagacagcctactagagagctgggaggatatcctcaagacaactagaattgcaccgctgggcttagtctgtactgttgaaaaatgcctggtcgattctcgctaaagaaaaaaatctgcaaagctttcgatgctggttgtcaagcttaaagcttacttctactcctagatatagtatatcagtcttccctcttttctcttattgctctggttcaacatattgccccattaggactagagtttgaagacaatgatgttgatttttggatctatcatcctccatgatgactgcaccactacttattatggattatctcctgagtcttctacttcactattttgatgcagctctaaatattttagccgtgttagattaatctttcaagttctgcttcatatgagacaaggatgaaaatgtcttctgttttgagtcctttttttgttccttattctgctcctatccttattaagataatgaggatattatgcagatccatatctgcattttggtggctgttaaaaattttgaatttttgtctgagtctcctagctcaccatcagtatggcagtacattcatattttggtttttaagtttggttttctcatcatggcacccaactcatgttctatgataatgatgaagatcgacttcaacgattctcttgacacttcatttctactcagatcttcagagttaatgcaagctttactcttgtagatagcgagacgatgatgatgactttgcagattgagaagtcgttgtgattcactttgcagctctcattttgggaggtattaggcagttggttttgtctgagtctcctgtctaaatttttttatgcttgagatggttggttttttcttttttgtcagtatgcatgtcttttatactagaaagttgaatctgagtctctcattggttgcccaatactgtacacaattttttatttattttaaataatttcggtgactaatgttgctactgcacattagtctcctttttactcaaaaaaaaaaaaaaaaaaggaccaagctccacctaccttatctaacgctcttcacagagtgaggaacaagatagagaggttaacttctcatagtaaaccttagggaattcaacagaagtgaaaaacggattgacaacccaattgggcataaggtattcccagcttgggaaagtctccatagctttgttgaaggtttgctggggtatgagctcttttgccaaggaaaataccactgttcctctcgagtcatattctctacttcagagctaatctgaaagagtcccagaatttctgttcttagctctaggcatgctgctttaagagtcatttttcttagccaccttattctgagaagagcaccaacttaattccaaccatgatgagcacggttgcaattcaataagaggtgaccaccggtctctgagctttctttacatactggaaacagagaaacatggctctccattcccatttggtttttctcctgtatgtaacttgttccacattggcctttcaaaaaacaaaaccggttcctcattgccaaccacttctccctggttcgtgaatctgttaggacttcactgaacaaacctcgtttgcagtccatctccaatctgttccgtcctgactgtccaaaggagagatgccttggaggatgttcgctaattctcttacctctgttagtgcctggtctgacagcggggtgtccatcgtaactttccagctcctggttgttgattccaatactctgctactaacgcttcttccttgaatgctaaatttactaaagaattgtcctccgactagatatcataccagaaaaatgtttttatctgtcctaagagtcaacttcagactgctcaggaatggattcagaattttgcaaatgtttcttcagatggccgatgctttcgtcattttcttcctcctggtacagctaaagttgcctcttatcctggactgttctccatcagttagtagtctccatgcccatttagagagcatcgccagttgaaacatgctaaattcaaaatgcccattccccttcttttccttgcacactgccttccaattgaccaggttagctgttggtaaataactaggctttccacaacctagaaagcttcttctcaacttatctaattcaatcacttaccaagttgggaggaggaacagagaagcataatagagagacagggctaggaggaccgaatagagaaacagagacgtataatagagagactctggctgccggttagtttctggaaggagtcgtcaagagaagaccgaaggtgggttgcattacatcgcaggatggtacctagttgcagttccctttcaagttgctaacatagatcctatgtccatctcaaagggatcgcagctttgtttccttcagctagagctcctgttcaatctatgcttactgtcatttaccaattctcaagcttcagccattatcgaggtggttgttcaactgaagtactttcatctggtttttttgaattccattggcacagtatgctatctttgaagggctgttcttttttgttcatttggttgagccttgcaacaaaggaaggaaacattttgacaggtagctaaattgaatccgagagtagtctgacaggatgctgatcttacctcctaaccatcagccggttgcaatcttctcctcaccatattgctttttgtttcatctacttttctcgctagctgttacttattcccctctgccttcatattgtactttccatctctgtctcctttacctctcatatacatacctccttcacatattcaataaatttggtgggtcagcctccgcttccctttaaaaaaaaaaaaggaaagaaaaaaaaggggttgctaaccaggtgaaacaaagaactttcgagagtttgatctttgagcctgatgcaaattggaagctcatcagtataagcttcaggtgagtgatcctaggggtatctacttcacaaaaaagaatggtgtcatctgcatattggaggccaaggatcccttcattcctgtgatcagggccaagaccttttttttttttaatataatccaagacactagccccatgcaaaatccttgtgagcatccgaggttagaatagatagggtaacaaataatatacctgggcttatatttttctctttttctttttcattttttccctttatttcttggtaggtcagggtgatcctggaattacaaaatgatacaatcggttaaacaaaatgtaatatgctgatacattcttttgcttattggtgacaaaaattgtcttctcttacatccatcaatgtctcaccactatcgtggttccatttcagtgatagagacaccattaatggaatgtggtatcaatctcgctgttcttccaatagagtcctcgctccctgagaaaccagttcccttactcttattattcacctctgagtcactggttgttccacctcttacaaagaaggcaggcattgaaggggatgggagaccgactgagtaactagtaagcatgagtacaattgatgtcatgtcaggtctttcttctggatcttcctggatgcatagtagcccgatgtgaatgcttctcaatacttcttgcaatgtacaccgatcacccagacttcgatcgatcatctgtaacaccattccttcattccagtgttgccaagcctatttaacaaatatgtttcgaggaactattaattactgcagagatttcactaaatgcaattgatattggtgatcgtagatcaactaatgaccagatgaatgcttacatagcttagaaggtctgcagcttgcgcagatcgttggaaaccattagccctccgaccagtcaagatctccaaaactagcaccccatagctgaaaacgtctgatttagtggagaagtgcccatgcttatcatattcaggagtcatatatccattgcgataaagaatttgacaacattagattctgtgtgagcagatactgatgattcaggtcaaagatcggaattgtaattggttagttcttttttttttttttttctttcactaattaagaagaggcattgatgcggttgtgcttactgggtccccgcaattcggctggtgtttccttgggactcactcatgctgaaaagctctgcaagtccaaagtctgatatcttaggtttcatgtccctatctaacaggatattacttgctttcagattttgatgaatgatactcagtggagaatcctcatggagataaagaagcccccggccaatcccttcaatgatcttgtacctcgttccccagtccagttgttttcgtctgataggatctacttcatccaaataaattttggtaaattatattgatgtcttagagcttgaactaacaataacaatgaagctgtgataaacaagatgttagaaacactaagagggtaaatatttaattatgcaagaatagctcaaaattctcctaaaagaataagaatagctcagaaaatagttaaaactactagcattcacagatcaacgcacattgattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgacagattggacataaaatagcttagaatcaagctattttgataataccagaatcagtatgtgaccaaaatgcaagaaatttatctagctacatgtcaagcttgcctagggatatatatagctgaatcacaaaatccagagaaccaaacagctaaatttaacagaataaagaatatctttttataaataaaataaagattatgtttttgccacaaagattcccagataacaagcatcacaattagcatgtatacaaaagtagcaagaaatatgtaccattcatttcggttaatgaatcactgtaacaggctttattcaactacttagttaatgatattcctatttgtcgacactatttcaacattatggtgatacttaagatagagatgcatgtattgtgcgtaccgaataaaaatttgtcaagacctgtattaggaaagtattcatagactagtagcttctccttctcctccaagtaacaacctaacagccttacgaggtttctgtgttgaagctttgcaaacaaaaccacctggtttcttagctctcctagtccttgcccggagcttcttgaaagccttttcacagctatctgctgttcatcccccaaaatttcctgtatgacatttacaacatgcatgaaaacaattatgtatcactcaaactcaatgacaatatttttggagtaatctttcacacatttgtcgagatgattcccttatagactggtccaaacccaccttctccgagtttatttgcatctgagaaattctttgtggcagctctaatggtgtccaaattaaatagcaatggttccccacttgtgaaatcctcttcatctccattatctgcccacagaccaaagtttaagtacacaaaaagcatgctcactttgtcttgagaaagaattccaagaatgataatgctgcaggaaaactcacccggccagtacccttctaacaggtttccttcttgtaaagtagatagacatgatgaagaggagaagtaacatggcaaccacaggtaggacaataattagaactgtttttgtggtgtttttactttttcctgcgccaaaatgagattacaccacttgtcattcaagaccataatttttaaacgagagttcgaaaagcacaagtcacctgccatccatcgagcaaatgtatgtacgtgcatgcatgttcgtatatatgtacatcaatatattagtacttgggttaattcatgatcaagcgaaaattaaaaaaaataaataagaatgagaagtgccaatcaactttggcttgatcggttggcacctctccactttggaagagatctaaaatattagaaaataaggcttagcttattttctaatatttttatctttattaatctatctagtctaaaagttctttcttgtgcatctatagagttgagatatttggaccctctttttttttttttttgtggtaaaccaaagttcattaaataccattttagtgtgaatacaattttcagaatcgaaaaataaaatgtctaacaattgtgaaggaaaatcaactataagcaaccacaatgtagatccggtttgatcttagacccatttttcagattgccatctagttgagaagtctgttctcccatacacccgttcattttgaattcttggcccatttttttttattgatattttttcttatttaattctatttggcttggactgattaaaggttttttgctattgtcattaacaccctggtagggagagaagaatagagaaaaaaaaaaagaatgggagaaaaaattattactttcccttggttgggagttttttataaacaaaatagaaagaaagggagagaaattgatagaatacaaatcccctcaaactataattttcttttcctccaaatagagcagaattggagagaaaagaattgagagttagtgaatcttttataatttctatcttatttctttgatgataaaaaataaatttaatattatatttcaatcctaaggcttatttcaagcaccccatctaagcctcacatctgattgaaactcctgtggatgaaaaaatcaatgaaaataaaaaaattaaaaaaataaaaaatattttttttatttcctttcttgaatttgttaggttcctttcaaagatataatagtaaaagaagattataatattttttttcttctttgcttcctatcaagaagcaaagaaattattatttttttattttttctttaaactttcaatcaaggggaaaaagatatacttttttttactaatattttttttctttctttttttttctataaactcccaaccaaaaagtaagaatccgctttctctctctctctctgtttagactcctcagcgatgcaatgatgggtgcacctcctccctcccatcgcaacatttattctcattatatgtatgtgagggaggggcttttggataaagtcagagagggttcttttgtgtaagttatgaatttgtttgaaatgtatatttattatattaatgttttacaagtttgtaaaatttatacttatatctagttaaattaatgatgttaatgaaaatatttagttagtgaaattatttatcttatataagaaatcaaaattatcttttagtagggaggaggatgcacatattttgttatatatttggatggctcttgtatcatttaagattatttttgttatttttgaattttttctagttgacttttgggttctaattaatgtcaacaattttatttttattctattaaattatggattaaaatgttggataaaaataaatctcaagaagaaaatttaaaattttcaaattatttgatataaatataatttatttttattcttagagagatttctgtaattttattttttaacaaggaaagattgagcactcctagtcctattaccggcatagctgaatccattgtgtaatcattaatcttgatataagagagagaaagagaaaatcaaatggaatatatctttttatgtggaccaagatagctctagggatgataattttaatcgattcattaaaatatctaatccgatttgaataggatggattttatttgatccgattagaatctgagatggatataaattttagaaaaaatatccaaaatagattcaggtcaggtatggtaatggtatactccgcaccgaatccaactcgatataatcttaatatatatctctttttcaaaattttaattattttataaaaatttatatgtacctaaatcgatccaacccctcttatctatccaatccaatctgatcagcatttctatttgactcgatccgacccgacccaaatatggatatggggtttataattatagggtggatatgggtatcagctaacccgcgtatattcgacttgttgccatccctaaagaaagattttgtttatagcgcttggcaggattaaagtttttgacatatacatgaaataatagttggcattctcaaataagaaatataaataaaataacaaaaagaatctcacactatgatattaaaaatataaataaatataaaactatttgatttggttgactctacatcctttgacaaatcaactagtttgaatcagatcaaatgttgctcaattttaatggcacttcaaagtcaaatagaaggtcatctgttaggatttgacgcctcgagattcagcccacattgagcccacagcgaggttcgcggcgaaaaatggagtccaacgagaccaagatcacttgaatcggagctcggatggaggagatacaagcttttgaagtcgacacgagaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtggctgatccacgtattttgattatttttccttttgttttgtttcttctttcttcctgctgcatcacgtggtactgaaagggtcttgggaggtggtgtcctggccagacatccacccaacatcatcatagcccaaaagagaacacgttgattgaaaaattcttacattacaatctaggtatccacgataaagactcaagttccaacttagaattaggagctccatgttgtgtgtggacagtttgggaagaggataacaaaagttgatgaagctacaaaaattctgcggaaggagtagaaaatatttatcttaacaaaaatgcatatatcaaaactaggaatataatattttccatcagattagaggaccacaaccatccatgtaaattaaagcattgaggtaggattgacaaccaaacaaactgttcgtgagctagctcagatttacattgaaattttactcaaattcaattcaattcacttcattaggaaatgaacagtgctatagatgtgcttagctagttcaggtctaatccaaattagcttgagatatgtatattaaatcacacatatatactctacatacatacatattttttaagttattttatgcataaaaataattattttatagttatttattataaagtaatgtcaaccatgtagaatagaatagattccaactatatgattaaaatacaatcaagatttttacgttaatctatctaaatgaaaatgttaaataatcttaaatgttccctacataacagttatttctgagtagccaagctagattgagaattagataagctagcatgagctcagcttgatcataaaataagccaagccaaagataggggtaggttagctcatgtttggtttgtttccatctgtattcaggcaggactcaatcccatgccttggtgccaaccttcaatgacctcatcaattgaattagttgacacacacttgaaagcttcgtcttgagcaaagattagtgttcatgtcaacgaaggtgttgtttaccgataccacaaagtgttagctcgaatggttaccttttgcctcttggacgagaggttggtgttcaattccaagcggcatggcacttatcttggctcctgtttacgaagtcccagttctgtgagctaaggctctgttaatttgttgatttaggatctatttaaaaaactctctaatggatccaataggatgagctgggctgctggagaaagggaaggagtagttgaggggatcgtgggctctaatcctcgttgaatgaggagagagagagagacgtccttctttaatcctatcgggatcaagctgcaaacctccatgctcttcctttccactctccaatccctcgagatctccacaaatctcgttggatctggtggtagacttgcacatgtgaagggccgagtcaagtatcggccgagcaaagtcccatatcaacaaagagataggacaaagcccagcccagctagacctcatgtctgtcaggctcgagcctagtccaatctttatcaagactgaaaaatggagacctcccctgattcagcaggctgaaaatctcagtccaagcttgacaaaaatggagtttgcttagctccacccggtgggaatggtcaaccaaacccttagccatatatgaagaaggtattttcatcttcaggtgtaacggatggaagtcactttcacttattagatttaatattttttatcactaatattaagtaatgaacaggtagatgaagcatgcactgttggtaattgggacacgcagctacatgttcaggaaaaaactttggcttaccacgaggaacggacggcgtaaacgccggagggagcaccgaccaggggaagaaggagtaggtctgaaacctgagggcacaactccccttcaggatctcccccccagccctcccgtaacagcacgtaggcaaaagtgcaaccgaatgatggaggcactgggaacagccactttgcgacaggtcacgtgtacactgtcccatcccatatatggtcccagaatccgagaaatttctggtcccaccgcaaatcccaactcactcgccgccgcctgcgacgagatctcgtccatcagagcccccaacagccgattgaacaccgtcggatccgacgcgttctgcggatcagcgagcatcgaggtttggtcctcgatgagctgggagaagaagtgccggtcggagtagcggaggacgcagaggtcggagcggacggcggcggaggtgcggcgggggcagcggagcggttgaggcaggcggcgcagtcggagatggtggcgtctgggcggcactgggcgaggccgaaggcgggggcggaggagcgagcgccgacggtggcggtggagaatagagcggccgcgagggggacggaggcggtgagattggagaggaggaggccgaggttggtggcgaaggtgctggcgacgatgtagttggcgtcgctggcgcagttagtgtagatgggtacatattgggaaatggatttggtgggaataaggagcagagcgggaaggattagaagagggaacagcaaggaggaggaagccattaaggggtatttcgggaagagagctcaagatgaagagggggcatagaatggaaatgttgctgaaaagaacttttggttcgcgaagcgaattacgcagctaataaagaatgggggattgaacaagcagccctccgtttctaaacggttgcctaagctgtagattagggcaacggagactaaagttcctaaactgtggatttagtcaacagaaatttgtaaaatggaagtgaaatagttggaccagatcgtggatcggttcaatcagaaagtaatagtaacatgtgcttagatgattttgatcgcttttctctcctttttcttcttttcatatttaatagcaatatgtgttaggatagattagttaatggtccatgatggatttgatccaactaatattttttttattttattttatgcttattttacagttagttttttttgatgaaatctatcgtttaggaaactagtttctattgattaaaatctaaggtttagcatttaatgcattgggtctcaaaagtcgagcaaccgtttgacggcaacattcctcgtatattggcttagattagtttattcaaacgaaaaaaaaagctttgataaaaaattaaaaaaaaaattaatgtttgcactttaaggggccaagtttctcctcatgccgtcatggccgctacgaggatattagggtttcccatatgaaaatcctataaagggcttctactatttttctcttgttctatattttttcttcccccttcaaccctctatacaccttcaatgttcgtcgggctacatcaaataagatgaccgtaggattttccactttattgattcgatgaaatctgcttacataatcaaatggacgactcccttttctaaatatgatgatgttagaggcaaaaaggtgatccaagaatgacttgtagtcttccgacccatgctcacaaaatagattttatacgagtgctaaattaagatcctttagaagaccctaattatagctaattccacaactattcttcatgacaagtcatgcaaaacacaaaataaaaaattaattttatttataatatttttaaaatatagaaaattttgagttaatataattattgaagttctacaaatcaaaaaacttagccagccatactgcatcatctctcgctaatccaaagttaattttgagacttctaagctgtggttatagccaagagacgtacgagggttctatcttccgcgtgaaagatctccaagagagagcattacacaagaagaactgctaatgccttttctctctctctctctctctctctctctctctcatatagaaaaaaaatgttgttgacaaaaacttttggctcaccaagtgaattacacagctaataaagaaggggagaatgaacaagcagccctctgtttcgaatggtttaataagctatagattttacttaatagagactaatttcctaaactgtagatttaattagtcaacagaaattaattgtaaaatggaagtgaaatagttggaccggatcaattcaatcaaaaactaatagtaataacttttttcttctttttcttatattcatgtataatagcaacatgggcttaattagatggatttaactgcttttctctcccctttcttctttttatatttaatagcaagatatgctaggattgatttattaatggtctacggtggatctaatccaattaattttttattttatttttattttataattaacttttgttgactaaatctaccatctagaaaattagtttctgtagattaaaatttatagttcagtgtttagcgcatgactgctcaaaagtcaagcaaccattcaatggcaacattccttaattctttgaaccgagcatatctcaacttggatcagtccatttgaaagaaaaagagagcttcaaattaaaaaaaaattaatatttgcacttttgagggccaagtttctctccgtgccatcacggccgctaggagcgaccaaaaaatcttcccttttaactattaggaaatagttactcaaacatgacactcttgacatacgacgatattaggatttctcatgagggaattctataacatgcttctactattttctcttgttttattttttcccctcctccttcaaccctccatacgtcttctatgttcttcgggctacattaaataagatgaaacaaagatggaagaagaccataggatttcctgctttattgattcgatgaaatctgcttacatcatcaaatggaccactcccttctctaaacatgatgatgttagaggcaaaaaggcgacccaagcatgacatgtagtcttccaaaccatgcatgctcacagaatagactttatgcaagtgctaaattaattaagatcctatagaagactccaattacagctaattccatgactgttcttcctgacaagttatgcaaaacacaaaataaaagattaattttatttataacattcttaaagtacagaaattttttagttaatataattgttgaagttcgataatcaaaaaatttagccagccatgctgcatcatccctctttaatccaaagttaattttgagacttccaagctgtggttatagccgagagagggatgagtgttctatcttccgtgtgaaagatccctgagagggagcattacaagggaagaacttctaatgccttttctttctctttctttttgttctctttttgatacaaggggaggcaagatggccacccgttactagtaaagaagtgtcaaagaatgtaaaatcaaagtttttcttctctaaggaagcttgtatttgccactattacaaaattccagcatgtggaaaccaaccaagatatataaccaaaatacaaagctctgcgtagcgaataagcagaggtaggaaaccagaatgacaaaaccatcctgaaaagcagaggtaggaaactctgaatgaaatgcaatgcttggtagtccgcagagaattggtaaacttttgaaacctgatcactgaagtgaaggatgcttctgactattcccagggtgcagcatcataccagtagagtataagtatgatcgagaacagcggcatgcatgggaacagaagagacattgctaggcgagcgtcactttcatttgcagaaaattctgaccgttccgatgttgtttaactgcttacgtcagtagatgaaaacgtattcacagattgccttcaaacatattcaaataatatttatcaaaggtataattttttagatggaatggagcaaaattttatcttaattgaagatattattgatattttatataatttttttaagaaaataaatgctcaatcaaatataaattatttttgaatattttatttttttatgatcaatcaaatatgtaaaaaaatattttctcaaacatcacgcaccctgagctaatacagaaaattttttcttacaaaccaaacaaaccctgaatgatagctacaatgcttcgtagtctgcaaagaagtggtaaacatttgaaacttgaccaccatggtactcatggtaccagaagctatcatcgcagggtgcaagcatcaataagaatagcgggcgggatgcacgcatgggaacagaagagagatagccaggcaagcatcactttcatttgcagaaaattctgactgtttggatgtcgtttaactgctaacatcggtagatgaaaacgtattcacaggttgccttcaaacatattcaaacaatattgtttaccaaaaatatatatattcaacagccaccaccacagtacttctgaccacccagagaacttcttgctgaaatatgtaagcattcgcggaatttcaaattgccaatgtactccatgggccaagggaatatatgtactctaattggagtcggaccaagggcattccttgttagcactagcagctctgcaagaaggaaccaagagaggttgccagctttccccattcctttcctcccccgaatcaccatagctctacaaacacacagatcttccaatgcctctcaacctcccccatgaactcctccaaatcctcttcctctcctccctcctcgccgccactttccacactgcaacctcccccggatactgtgagtgctcgaccaactccaacttcaccaccgacagcacctacaagtccaacctcaacctcctcctgccctccctcatctccgccgccctccccaccaattttgccaccctatccaaaggccaacctcctgatcaagactttggcctcgccctatgcttcgctgacctaaaacgagacgaatgccagacttgtctctccgccgcaagccaaggactccagcagctctgcccgtggagcaagtccgctgccatttggccaaacacctgctacctccgctactccaaccacagcttgtcctcctccggtgatgatgactcatatagaatgtgcttctacaacccagggagcgtcacggagaggttcgaagacatggtgtgggagctactgggcaatttaacgaagcgggcggcgtatgagtcgacgcggatgttcgcgaccggggaggccaaattcaccagctcgacgacggcgtatgggctggcgcagtgcacgagggatcagtcggaggatgagtgctaccaatgcctgcaggtgtcggcgagaaatatacatacgtcagaatgcgtatgggggaggccaggaggggtggtggtggcgtaccgttgctatctgaggtttgacatctacccttactacgatctgtctgttggagtggcatcgcccgagccggcggtggactgctgcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatattttttttaaaaaaattagcatgcttatcaaataaaaaatttaaatttcatcataaataacacaatcaactcatgatcgatccaaaataagtcggtgttattagtattccttatacatatggaccatagagtcggtctactccgatatcaataaaaataaattaattaaaaaatattattttaatttttagatcctatatagatattcaagatttctctattgtacagaagataggaaactaaatgtatattcgtattggttcttatagttatactgatgtacaattgggataatgttttgttacctatccatgaattgcagtgcaccatctttattgctatatccacgcataatgcataatattctttagttagattttaattgcatattgtgtggttcatgtgttggttactttagggcactagcatagacactactgggtcatattaaattttgcgtgctagtttcaaatccgctggtcacaagaaaccatcatttgcaacaagagaactgccaaaccgtgatatcaattattcatgtatgttattattttttcagcttgtgatcacgggtggatcaccttgagttgttgatcgttaatcatggttcagctgatgatagatcttaggcagtaatttgttgagtataaattttcttttatataattaggcatttatttatcattgcaagctaagctcaaaggttattatcttggttcaggaaggaagcgcaaggcaatgataatttttcttgttatcccgacggttagcattctaattgtcttctctggcgccattttcatttgtttgtggaggaggagaacatctataaaggcaactggtgagtatatctcaagacgaacttatatttaggaagcaagaagaagacgtgtactgttgtttttttttttttgtcaaaagcttacatactactcatggttttattgaaagtatatttcatgactagcagatgctggtcacgacaagggaaacattggatctctattatttgacttggacacaatcagaattgccacaaataacttctgcgacgcaaataagatcggaagaggtggctttggaccagtgtacaaggtaaaatgtagtctatagcctgctatagacttcgaaaagtgtccattctatttgatttaaacacaaatatttttctgtaccaaaaagagaaacacaaatattttcttctaatactttaatttgaaacagggattgctattaaatggccaggaagtagcagtgaaaagactttcagcaacttctcggcaaggacttcagcagctgaagaacgaggttattttggtcaccaaactcgaacatagaaatcttgtaaagctgttgggttgttgcttagaagaggatgaaaagctccttgtctatgaatttcttcctaactcaagccttgacaaatttttatttggtacgtcagaaatgcaacttcttcaagaaaaacccgtcctcttaatacactgaaagtgccactaggttaatttactaaaaagccttacattgtcagatcatatgtatcactaaaccatgtgagtctactatattttgtttacactcaattttattcaatttgcaatattattttttctcctaattaatgatgacaatattgcctctaacctcagcgtaataacttgcattatttgcttaatcttctcaaagtggatttggtgatattattctgaaaatgtgtttgacttggagctgtttcaaagaatgagataaaattttggcttgtctcagcatagttaaacaatacatatcatgcctaagttaatactgatttaaatcatccatatgtttatttcattatgttgggtattgtagatgactacatgctcgcttgaccatacatgctctgattgctatctacccttctaacattaaaagttttatattacctcacgttatattatactaccactctaccttagtttcttgttgctatttctaatacttacccaagtttcataactgttctcaatataaattgaatgttagtttttttcaaggataataatgtaaaggaataatagtaaaaaaaatctaatgagagggcagccatacaaaaacagaatgatttaaaacctacacacacacacacacacacacacacacacacatacatacatatacatacatacatacgtgatgtgtgtgtggatagtgattttcagaaggtaaaaaatagtaagttctttttttggttataatcaataaaccatagtggcaaagatgcatgcaaaagccttagtattttgttgataaatgaaataagatgcatgctgaagcctacaaaagaaataaaaaggaaaggacagtagagagagagagagagagagagagagagagagagagagagggagggaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagagagagagagagagagagagagagagagagaggaggagaggagagagacctaagcccaagcaacaataccgcctaataccagcccaacaagtaatattgttcaatataagctcaaccagcaacgcttgaccccaaaaggacaaatcagaggggtgctatcgagttggctccgagatttactaaaccaggactcgtatccgtcgattttttggtctaactattgtttcatacctaatctttaataggatccgatctattcttggtttaggtaataaatatgtacatcatgttcaaagttggatattattcgggtcttggtttaggtattaaatattatgtcttaaagagtaaagcaagttaaacatactttgagatgtttataaatatttaatatatgctacaaaaattaaattatgaacaacaagcaacggatagttaattatataacaataatgggctaaaaatcaaacagatataatttacttaaaatcaattatagatatgtaaaagtgttcaaacatgttacttttgttattttgcaggtgaaagatatataaataaaactaatattgtatagatgtatgtatgcatgtatatacttatataagtgtatgtgtgtgtgtgtgtgtcttgtatatatttacatacatatatatgtttgcatcatatcctaacatctggggatcaccgtacatgtggtggctctagaatatggtctaagaaggggttccaaatcttaagctaaataaaataacttttcatgcattctcatcaagaagtcaaagggcaaatatcatttgaaaggctaaagcaacaaacactatataaggaagctgatcaaattagcttgaaggtgctttagagtagggaagaggtctataaatcaattaaatagagaccactagggtaaattactatgagcaagccaaaagaggatattgcgacaggccaatagagtgtgagaagtgttttgacaaagaatatctgatatggtcattatgataaatatgacttatagaggatagttaccattgatcgacagaaataacaaaagtggaggccaaattggctactattattggagtgggtagttatcatattattcatcttctgacataaataatagattgtagtttgaactgaggatcctttgatcaatcaagaaaactaatttatttttaacttatcctcacttttatctttaaattccttactttaaaattctagtaggactcttataatttattattagtagaatacttcttagtagtactggtttcaaactttctttcatctttcgaatgatcagtgcaatgataaaaaaaaaaattgaaagtcaagacatctaaatctacactactctcatcatcatcctttcattatccttcttctaggaaatccatactgatggcacgcctatgcatgtatcctaacttaagccacaaaacttgtcacccttctctacaagccaatgagctcctggcacgcgcatctctctcctgatagaaaggagaagaggaaacaagttttctagcactcccaatgggactttggtagcattttcagtaggacttgttggcaaaatttttctggcatatttggtgaaatttgtggataaatagtatgtaaatatgtacgtacacatgtgtgtatatagtaaacaaagtattttatgaggacttgggtaggatcacatataaaaacttcaaacccaaacccaacctgaatgtctcaatgggtttgactttaactatgttcccaacgcttttgtaggtacaaaacaagtaaataacccccactcaattccaaaacaacagcaacataaataaagctcaaaaccagaacaccgtaacaccgtaagcccagaacaccgtaagcccaacttagttgacccactgcattcaaagttcgaactctcttaaatgcttacccatctcctgatactaggggcgaaagtgatatggatattatctattcagattcatttatatatctgaatcaatccgaatatggataaaaattttaaaatccgattaatatccatatccatatccatatccgtcagatatccatatccatcagaaaaatatggatatggatagacaactatccgatccgtatccgaatatccgaatctatatgtaactctatataattttatatagtacttattaatttttaagagaaatatataaatatataaacatgttattaacttgatttatcatctatttaataatatctttgaatctatagtcataaaatttaattatctaaataatatatgtaattatatccatacttttagtatctaaattttatccatatctatttaaaataaatatggatataaattcttacatccaaataatatccgtatccatatttgtattcgtcagacaaaacaaatatagagatggatatggtgatattcgatccatattcgatccgatttcaatcctatttggtatctaatctacctaaccaccacactgatcggttcggttcacttgaatagaacaacaaggtgaatcaggctgggcctaatgccacatcactgctgtctcctggcctcccataagttctacacggctgctgattaggaactggcttacccaattttagcaagttgagaatctcatccttcagcagccaactacattttttgagcatggatttctagatggctgccatcatagaatgggcagtcatcaaataatgcacgcaacactgcatggcatggcccatcctcgtgtatggccatccatcctatgatggatgctattcataggtgcaccacatcccatggtgctgcacacacaccataggggatgcttatggtttcatgatgcttagtttgtcttagcttaatttatagctttgacacactattatatgactttcttttcattccttgggctgcttgacgagtgattaggggtggcaataggttgggtatgagtcggatcgatcgatacgtgtacccatcccatcagcaaaaaatttatatccatacccaccccgtatccatctcggatcaggtcggatctagccgagctccaaaaatgagtcagatcaggtcggatcagttatatccgaaattcttatacagttttaaaaaaaattatgcaatgaaatagagccccataaattaaaaattttgtagccaaagcagaatcttttcgatcaaaaatctccacccttacaaaatatcatacttctaccaagattaagctctcaaaacctcaaggaactaactcacaccgccataacttggatagaatcccatatactcaaggagaagaatccaatcagaacctcgaaatcccttctaatctctcttaagtgctctcttttctcacaaatctatcaaaatgataatgaaaaaaaaaaagcaaaaagaaaaaaaatggcaatctatgtaggaaaaggacttatcttttaatttttctatttttcttttgtttttcttggttttccttcattttctcctagtttttcctttgctttttccatcctcaagagtcctaatcaggtgggaggtttgaagtggctgaatatggaagcttaggggagacaaagtggccgaatacaagaagcttagatgactagggttttgtattgggtatttagatgtgtgtgtgtatacaattttttttctaaaattcatatctactccagattttaatcagattggataaaatccgtctcattcggatcggatcggatcggatatccaatgaatcagatcaaatcgccacccctatgagtgattgaaattgtgatggtctgtgatattgctgcgccacataatatatctgagcttaagcaatcattattagaaaacttctatcttgtcttgttctaaattcccaccaagaatgataaaaaggatggttccaattggctccaaaattgggcagctagtgttgaactttgagaccatgacatatatatgtatgtatgtatgtgtctatatgtgtgtgtgtgttgcatatatttctcaatatagaatcaaagttggaaagtacatgggacatcactttgggatcaggcataactggcggatgcttttcttgaaatagtgaattttctttcattgccgtggactggggctttccctagtggtcgtacacttctcctgccaactaaaggtttgagttcaaattttgaatcgtgcatcacctagacctaggtaattatgatgcaaatggtcttcttctccttccatcagagaatgatcttgtagtatttattatttttatccattacataaattttgtttatttattttcttctcttttgatcggaagagatcgattgaccttgttattgatctatttcatctatgagtcaattttctttaatattacactgtcacactaattgacgtgaatttcagagaaaaacttatatgcaattttgactgtgacctatacctacaagaccaattctgttcatgcgcatcaataaaatttaagttcttaaatttcaaaatatcattccatcaaataataataataataataataatatcatgcaaatccatgacaacctgctaacttaagtcaaatcctacgagtagtccattgtaaatgtaagagaaggctggactctgataggtgagcaaacagatacattaagtcgttctatgaagtcgaaggataagaaacgttaagattgtaccggtaaggatggattttagtcgtctatcattatgtgtcgggcacaagtatttgatccaaatggcctctatatactaattacctacttaaactctggtaacagttgatgtcaaaaatcttgcttattctgtttgatctgtcttcttctccctttttggaaagaataatcatagttttatccaagaaccccatgcttctttgaaattcgatcattgtgactttcttgcatacgctgacttagttctactggctaacttagatccccgcagaagtggagaactggagtggggaaaacgctacaagattattgaaggaattgcaagaggacttctttatcttcatcaagattctcgactcaacattattcatcgggatctaaaatcaagtaatatcttgttggatcagtacatgaatcccaagatttcggactttggccttgcaaaactcttcgatgcagacaaaacgccggggactgttagtcaaattgctggcacaaagtatccttaaagcctcctcaacttctgcatctcgatcaagattttaattacaaccactggacaccataaattcttctctattatgaactttcacttgattattaatgtaacaccccggcccaaaatcagccacagcccaaaccaaaaaaaaaaaaaaaaaagaaaagaaaacaagggagaagactcccgaagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccgaatgttgggttcggggcgtgacaattaatttgtttgtcctccgtagtctagagcacttaatcttgttgcttctgcatttgcttaaaaagaaatcttgttgcttctgcaattactgttgtggatggtatgcagtggatacattgcaccggagtatgcaatgcatgggcgtttctcaactaaatcagatgtatttagttttggagttctcgttctagaaattgtgaccggtcgaagaatcagagacttccaaggatcagggaatgcagcgaaccttctaagctatgtgagcactttgcaactcttcaatggatggaaaaggagaaaggagatggtagcaaagaattgcaccatgtccctcgtctaagactaacacgtcttatgttgatggcttacaggcatggaagtactggaacaaagcgaaggcattgcatttgatggatcaaagcctgggagaagagtatcaaagagaagaagccttgagaagcattcacgtggggttactctgcgttcaggaagacccaacaaaaagaccaagcatggcattggttgttcaaatgctgagtggtcactctgtaaccactctttcaactccctctatgcctgcatttttgaatcaaggtagcacagccaccgatctatgcgtggcttcaagtataagagattccgatccaccaaagaaggatgactcctaccgaaacaagggaacttctagctattcttctgaaaatgatgtaaacattagtgaaatcctactccaataacaagcagactaaggactttgatcattgatgaaaacaatcataagcttttagccatgcttattgttactggttaagcaaagataatgcagtagaatgtaaccaagggtgctttgatggatttttttttttgggtgatataaagggaggtgttgaccactcgtctattattgacaaaatcaaagagatacaagaaccagcaaggtagccacctatgagaattaggcagcaaccttgtggatgttcagataagaaacagacaggaagtgaggtgagagtaacaaaaaaaataaactgatttggaacggagagagaaagactcagagcaacagggtgggactgagcggcaaagagagtccagagaaatctgaagatgatctcaagatgttcgatggattgttacaactacagtcagtcaagaagttgatccagggtgagatcgctcgcccaccaaataaacaccattggatctgttaatagagtttgcaaggtaatatggcttcaagaagaagatatttcaatccaccgaagagcaagatctccaatctgtaccaggaaaatccaagtcggtcggtataaattgttgtgatgcttagtgaaatggaacctcgattagaagaagcacgtgaaacaatatgaccgttattaggaaaaatctaactcagcgcacagaggaatttgtgccgttgatgaaaacaatctaatcaagcaaagatatacatcgtaactcggaaagggtgttgggtttgtcgtcatactggcagcgtagagaactgtgtaactcaagtgtacaagcgaaaaaatttactaatttagtattgcagggcttcccaagggaatgttttttttgaaaaaaattggcgtacgccgtataattggcgtgcacacggtattctttggtaaaaggcgagagaataaactgtagctatgtgctcgccacagggctgcatgatctcactgtagctaacaatcgaattatgtaacgccgtgctgcattcgtccattacctttcaaccaatatgggaagagctacaagcagcagaaaagtggaattaaacaaagggcagaatcccagctacaattatcaaggagcggctacaaccaaagacagcagtttgttccaaatcttatcctaactatgcctcgtttttcttgaacaaaaatgcttccaatatttgaaagtatgcaggattttctgcagcacagagtacacagagaaggccgaggctcggataatctcatgatagctgtcttattattagaaacaagcaattggatctggacccccagctccatggggttgggtttggtgggctgacgaattgaacgcattaccagcctagaagcgctcgtttaccccacgagtgggatctaaataaatttgttgccaagagtgattcaaatctcagtcgtcccttgaatctgacattccagtcttgtcttcagactggaagcagctgattgactaacaattagattaactaattatcggttgtttcatgcagcattgattgaattccttttcttccggttcttccagctgtctggaaaaagaataatgcttccgatagccatcctgcgtggattttattttagagaaaacttggcaatgatgatataggaagtatttcccagagcattgcgacgtagacttggaccttgcacctgactcaagtacgccaactctgagttaaatctaattataagacaccataaataattttcagatccagatttcatagaaaaaaatatggaaactattttatagaaaatcttttccacggcatttcacataaacttaactcaaacatatggacttcgaatcaagtctattagaaacctctataaataattttagatccacatctagtacgaattgctttatagaaaatctttctccacagacaaaaatatgcggacttctggtcaaatctaattataaatcttactaaacaatttcaagtccacatcaagtagaaaattattgggattgttttacagaaaatcttttcctatgacattgtcatctagacttgaaccatgagattagatttgaatgcatagtcttgaggcaagttttatttataaacgcccataaacaattttaggtccacatctgatagaaaaaagtatagggattgatttatagaaaatcattttccacgatcttgtcacatagatttgaactagaagatttgacaccaacatgcgaactttaatccaggtctaattataaacccccaaaaatattttcatatccacatctggtagaaaaaatattaggactgtattatagaaaatattttcccacaatattatgatatagacttgaatcgtgggacttgactcaaacacgcagattttgagtcaagtctaacaataaatctctataaacaatttcagatttatatctagtagaaaaatatattagaattgatatgtagaaaatatttcctcatggcattgtcatatagacttgaaccgcgggacttgacttaaacatacggagtttgagtcaactctaattataaattaacacctatacataaacaattttagctccatatttagtataaaagggtaatagaactactttgtaggaaatcttttcctatgggattgtcacgtagattggaatggtggattttctatccatgatgttgtcatgtaggcttaaattatgggacttgactcaaatacatggactttgagtcaagtctaatagtaaatctctataaataatttcagattcacatctagtagaaaaatgcattgaactgatctatagaaaatttttcctcatggcattgtcatatagaagagaaccacgggacttgacttaaagacatggactttgactcaactctaattataaacaactatgcataaataattttagatccacatcagatataaaaaggtagtgagtctactttgtagaaaatctttttctataagattgtcatgtagattagaataatagattttctacccatgatgttgtcacataaacttaaattatgggacttgactcaaacacgcagactttgagtcaagtctaacaataatccccataaatgatttcagattcacatctattagaaaaatacatgagaactgatctgtagaaaattttttctcatggcattatcatatagacttgaaccacgggacttaaacacatggactttgagtcaactctaattataaacacatgcataaacaattttagattcatatctagtagaaaaagatagtgggactactttgtagaaaattttcttatagaattgtcacataaagtagaatagtatattttctaccatgatgttgtcatgtaggcttaaattatgggacttgacttaaacaagcggactttgagttaattctataattaaatcttcataaataattttaaattcacatctagtagaaaaatgtattagaattgatctatagaaaatcttttccatggcattatcatatcgacttgaaccgcgggacttgatttaaacacatagactctgaatcaactctaattataaacaccaatgcataaataattttagatccacatttggtagaaaaaggtagtgggtctgctttgtagaaaatcttttcctacaagattgtcacgtagattggaatattggattttctacttatgatgttgtcacataagcttaaattatgggacttgactcaaacacgtagacttggagtcaagtctaataataaatcttcataaataatttcatattcacatgtcatagaaaaatacattagaattgatctgtaaaaaattttttctcatgtcattgtcatatagacttgaattgtaggacttgacttaaacacatagactttgagtcaactctaattataaacatctatgcatggacaatttcagatccacatctgatagaaaaagataatgggactactttgtagaaaatcttttcctacagaattatcatgtaaattagaatagtagaatttctatccatgatgttgtcatataggcttaaattgtaggacttgactcaaacacgtggactttgagtcaagtctaacaataaatcttcataaataatttcatattcacatctagtagaaaaatgcattagaactaatctgtagaaaatctttcctcatgcattgtcatatagatttgaactatgagatttgacttaaacacacggactttgagccaattctaattataaacatctatgcataaacaattttagatccatgttcgatagaaaaagatagtgggactattttgtaaaaaatctttccctatactgtcttcccctctcaattaaacaatttcaggcctacatccggtagaagaaaatatcaaaactgctttatagaaaatctttcccaacagcattgtcatatagacttgaaccgcaggacttaactcaaacatatagactttaaatcaagtctaattacaaacctctataaacaaatttaagtccatatctgatagaaaagaaagtattggaactgctttatacacaatctttccctatggtgttctcatgtggcttgaattatgggacttgactcaaattcatggactttgagtcaagtctaactataaatgcccataaacaattttaaattcacctctagtagaaaaatgcattagaactgatctatagaaaaactttcctcatgatattgttatataaacttgaaccatgggacttgactcaaacatatggactttgaatcaagtttaattataaacatctatgcataaataatttcaaatccacatctagtaggaaaaagtattgggactgctctatacataaatctatcttcacggcattgtgacgtagattggaatagtgagacttgactcaaatattcagattgaatgattaattttaggcccgcatgctatagaaaaaaatattgggacttctttataaaaaatcttttcccaagacattgttatatagacttgaaagatgggacctaactcaaatatgtgaactttgagtcaagtctaattataaacctttataaacaaattcaggtatgtattgggtagaaaaatatattggaattgctttatagaaaatccttctaatgctattgtcatgttgatttgaattgtgagacttgactcaaacatgcagactttgagtcaagtccaattataaacctccataaataatttcaagtccacatctgatagaaaaaaatgttggaattgatttgcatctgatatttgacttgatatgtaatttgaatcatattagttacataacttttcttaaagagagagtagattgataagtatctatcccgcctcccactatgccgcttgatcacttgttccatgttccatttgaaagcttgtctgatatatagaaaagcctgtctgctatctagccgtgatacgttattgtcatttcaattcatttctcttttaggatctagttggtaactagaaatagatccattatccattaatacccaacaccttagttcttataaactctgataatttacccaaactcccataccgagtccatttgatggacaggtaaaattaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagctcgaaagaaatgaaggcccggactcctacgggagccgggttccaacgacgaagaagatttcgcccggactcctatgggagccgggttccaacgacaaaaaagactttatctggactcctacgggagccgggttccaacgacaaaaaagactttacccagactcctacgggagccgggttccaacgacaaaaatgatttcgcccggactcctacgggggccgggttccgtctgcgacgccatggaagatttcacccggactcctacaggagccgggctccatcgccgacatcagctacgggacaaccccgtccggacttctacggaagccggactttgcctatgactttgattgcaggaaaatgaaaactttgccctggcccctacgagagccaagctactccaacttcaggaggacttctccgctcggactaccaagggagccgaacttaaccccgacttcggcggagaaaaatccaagcaaaaaaggaaagcaaatagtgaccgaaggcaacgaaagctcgaatctccaaattcaagccctaggaggaatctcgggcccgaagggccccaagcaaacctgcaaccatcaatggaatgacaattgggtatcttcgaacggcgtaagaaccgaaaagtagctcggcaaatgacaaccccacatgaactgaagaagtcgccgacaaccttgggacgacgtgacacagacgaagagcaggaaaggaaaatgaagaaattcgacagacaactatttaatgcgagatgcagacgaggtaccaagatatctttttcatttaacaagagtatacgttacaggactcggtgggtcaggagaaaaagaaaaagaagatacatgtcatcgcaagtctcgcaagcacggttcgggcgggacgaaccggaggccgctccgagctacgaactcctctctccgtctctatccttctcagtcgcgttctccagtgcgtgtaacagctctcgccccatctcgcctcattctgttttcgaagtcccgaccttagcgggaaaggggtgggatagatctccagaggcggtaaggataacggcggcagtagcgaagacctgtttcaagaagaatcggagtcacctcggaagcggtagcgacgccagagatgtgcctcatcttcgaatgccccacaacagccgccacccaaaatgctccggcaaggtcggcatgcgctacttccaccgtccccgcagcaagtttcactgcctcaccatcgatgccgaccgcctccggtccctcggccccgacggcgttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagatttgctctaaggaatgtacagccatcacgtattcgatccggatatttgattcggggcgtgacatacttggtctttaagtcgaggcttccatttttatttccacagaaccactggctccctggctcccaacgcaaagactccgatccaagagcttataaattaaccaccatgcaccagtagctagactccagtatcctaaacgccaaaccccatggcttcctatctcctcccctgtcttccccaactcctctttctttcatccctcttcaccacccttcgcactgccacttcagccgccagcaacgccatgtactggtacaattgctccatcacatccaacttcaccacccacagcacctacaaatccgacctccaactcctcctctcttccctctcctccgacgccattcccaccggcttctccgcccagtccaacggccgacccccgaaccaagtcttcggctctgccctctgccgcggcgatgtctcccaatacgaatgccggtcctgcctctccaccgccgtccaagacaccctccagctctgcccgttgagtcgaagaggagccatttggtacccaacgtgcttccttcgctactccggcaacaacttcacctcttcccaagacaacgagacgattgccttgaaaagacttagacgagtctcctacgagacgcagaatgcctcggaaccgagcttcgcttcgctgttgggaaacctgatgaccaacttggccgatcgggcgtcatacaggtcggcgaagatgtttgccaccggagaggtcaatgtgacgagctccgagaggctgtacggactggttcagtgcatgagggatcagtcggaggatgactgctacgggtgcctgaactggtcggtgcacatcatgtcgactcacttcccacagagcattgcagcggtgacgatggcttacaactgcttcatgaggcacgcgacattctctttctataatcaatctgtcggggctgcaccgccgcctccaccagcaccggtggtggatcccggcgctccgccgcctagaggaaaggactcaggtaatgccgaagcttgctttctttcttcccaattagcgtgcatttacagccagcccttgaaatcatgaataggccgggctggactcgatacaaattaaatctcgattggaacaattaaaatatacaaagtccgaaggcaaccaagacgagctcagaaatattatgattaagccaagctcgaaaagtaatataacgtaacaatatggcttttcttatatgaatcgtgggctagcttttagattcctaacaagatgaacttaagtaaaatattggagttttggatcagggaaaaagaacgtgcccatggtcatctcgttggttattgcgttggcggtccttgcagccattttcatctgctgatggagaaggagaacatttttcaaagtatccagtaagtactgcatttgtcaagtttaatttgtacggcttcacgcaagccttttttgttttgttagaaagctcttatgctgttccatggctacctgatattattgaaggtgaggaaaataaagacatcgaagctctatattttgatttgagcacacttaaagtcgccactgataacttctctgaggcaaacaaactcggagaaggtggatttggtccagtttataaggtacaatatggactttatgtccgtaacctaccctatttctaatttatatcgtgaacctagcttccattcagtttaaatataacgctaactctttctcatattctgttgtatttgcaacagggagcactatcagatggccaggaaatagctgtgaaaagactttccagaagttcacatcaaggtcttccagagttaagaaatgagattacttttgttgctaagcttgaacacagaaatctcgtgaggctgttgggttgttgtttggaagaaaaagagaagctactcgtctatgaatttcttccaaatacaagccttgacaaatttctatttggtattttcgacatatatacattttctttttcatcctatataaatcttgcgtttatttatttacttatctaatattagagatcatctattatgtcattgctctattcgtgagtccttctattgaatcaatcaccaactttcacgtcagacttgtgaaccgaccggtaaatggatgcttgtaagtagctgtgatctctattttattaaactgtatgggacaagtcctatagatctttgtgctgggcaaacacaattcaagagattttttcttttttctaattgataatttcgttatattgtggcatcattttataggacaatgttgaattagccaaaatcctcattcttctctttgatttgatcgttataacattattatgtgctttgactagattttacctggatgatacagatcccatcaaacgtggacttctagactgggggaagcgctataaaattattgaaggaattgcaagagggcttctttatcttcacgaagattctcgtctcaagattgttcatcgggatctaaaagcaagcaacatcttgttagatcagcatatgaatcctaagatttcagactttggtcttgcaaagctctctgagtctgacaaagaacatggaagaactagtaaaatcgctgggacaaagtatgctaaaagcctcattaatttccttatattaatcaagattttgatcattgtctaataaataccaaaagttgttagcccttgctattataataatttatttaagtaacagaattttgtttcatgtttattttcccttatttcgatttagagtacttaacattgctgttggtctaacaaatgacaattgcttgatggtgtgcagtggatacatggcaccagagtatgcaatgcatgggtacttttcaaataaatcagatgtatttggcttcggagttttagttctagaaattgtgaccggtcaaagaatcagcgacttccagggatcaggggattctacgaatctcctaagctttgtatggactgccttttaattttagtcattaccaagtcatgaagcaaaagataggggttgtaaattgcattccgtagtctctccaagcttattcttttattatgactaatcttgttgattgtttgttaaataggcatgggagcactggagcaaaggaaaggcgttggaaataattgatcacagcctaggtgaattgtaccataggcaagaagctttgacatgcattcacattggattactctgtgctcaggaagacatgaggaagagaccttgcatggcatctgtggttctcatgctgagcaattactctgtgactcttccaactccttcaatacctgcatactttgttcaaggtaggacaacttctgagtcagatgtggccttgagaactactgattccactccatctggctcgttatctgtatgcaacgtatcaatcaccgaaatggagccccgttaagaaattgcgtgaaatttggatatttgatcgttgacaagaaaaagggcaagcttttccaaggaggctgatgatggattgaactgagaacgtattttacactgcaacttgcgtttcttttttctttcttctctacattatcaagcaatagtcagaggatgatctgaacaattaaatagagaacttaaaggacatatatattgctcatgttgagtacctatttatctcttattatcaatatttgactgtgtgattgttcttattttttcttttctacattgctgctttcctttttttttttgtttgtttgtttttgcctggaagactaatgattgggcgttggaaacaccttgcgttacgtacctccagagtatctttcactttgtccaagcccgctaacataagtggctcatatctttttttccctggtctgatacaatggcagttttaaattattataacggcaagacaaaaaatatatattataccacattataacaacaaggatgtagccaagaaggaaaccatagaagaaggccactggtggcggccacatggaagaccatggaggcaccctgcacctccagcgaaccccctcatcactcacttctgccttggtgtccccggcaccgcagacctgaagccggtcatcgcctctatgacgttattatcttggctgtccccttctaaatttaatttgatacagttcacagaaagaaaagttggttttgaccggttaacggtcaaagatatatatgtcattttataaaacataattagattttgacaccattcgagttgttaacacattggtgaaaaaaggtatatttgaaatcatattcagaccaaatttaaatgttaatgagcatctatgtactgccgagagctttgagagaaatgtatgaggaaaacgttcttctttctctgcacgtgcatgctatctttttcaaatgtgaatttgtttagcaccgaaaatatattaataatttaatttatacccaaggtatagatctttcaggtctcacaaattttcacttatgtagatcctaaactcagaccaattcatagcaaatagagcttgactcaaagattcaatatttggagaatttattgcatgcaccaggtgcaagtgaatcaggacaaatctcagagcatatgtatggtggagagcacgcaatcaagactccgtgaaatataaagggcagcatggtgtgttatcacggtctaattgtacctagtgctcacaatatggaggccaatatttgggttgagcttgaagagattttttttgttttataatatttcagcattatgacatgctacgaaaaatatagagtccatgttgatgaccttcttttgcttgtagaacagcaaacgttctatgatgctcagaagcatcttaggattggcttgacttatcttagaaaataaactgactcaaacaagttatagagcttggctcataaatgagtcgagcttgaacgagccagcaatagcagcaatagggaaactcggctcgttccgataaaagcttcacttagattttacataagctgagctcaaacaactgaggtcaatcttaactcagccaagttcaaacaacttattgttcttataacccaatattttgaatttttgttaattccttattgatgtgcattacgcgtctgttgctggtatctttgtgtgcgtgtatattagatatagaatctaaataggaggatatgagaatcagggcaagctcctgatcgtttgttataactttttcttatttgcataattttcttagacagtatattatgtgatactatacaaaatttgcttgactctaagcatccttgagcagacttgctcaaagaatgggctcaatcagattcaagctaagttcaactcaacgtatcatgtcatttagtcgagtctgaatctaagccagcccaatccttagatctattttttaggcccgaattcagacttcggactatgtatctatttatttatgtattcttttgatcattgggttggtctcagctgacaaggagagagtcttaaattttgagagtataatagaaagcatcggacagaggttgacatcaacaattgaatagagggttttatcaaaaaaaaaccaattgaataaggttatatagcattttctatttttttggtccaagcccatgaacttaagtcgctcatgctgcttttccatcccagggtttccggcggtgaccattaaatatattatctcactcataagcatgactccaaccaagacaaaccagtcttttaaattatatcatgtgtccacgtggatgcacgtacatgagatgttcgtgcgcccttttaatgaatccgaatgttggttcatataaacgacaaataaatatatcaataaataaatacttatttaataaggtatggcccgctctaattcatcaaacagccatcatttggctttatggggaagctaattggcatcaggttatggcaactcatcattcatcaacggacgttggatccatgaccgctttgatccacaggatgccgccggtaagacttttgagggctgcttggtgcttaagcaggaagattcctgatcagaccctggtcgcgtctcactcgctcccacatcctacagccggaggaggaaggaagcaacataccgtgacttcgaacgattaagctcaagatttccccttgttttcgtatcctttagaatctacgatctccagcgtcctacgcccgatggcgacggtacgcgaaacatctgacctcgtctctccgacctcttcttgatccaacctttgcttcttctcttctgttgctcttctgttttttttcttccccttcccgtctttctgggattcttgtttttcttgaaatctgccacttcgctatccagggttttattcgagaaaaccgatgtacatggttcaccccagtttctttgttttattttattttttctgttgttaatccaacctcttatctttcttagatttggattagggctgttaaataagtatcctttcttaccccttttagtatgacatattggtcgtttgaggaacattatggatacgcttcattagcccggatattttgcattgtctttggccgcggcggaatccaagccctcgtcagaccttttccaattaaagaagttgcatttctttgataatgggaagcacttgctgaaagcttagctttactgcgtgaagggaagaaggagcatgtcaacagacaggaggagatgctgttctcagagacagtgatgctcggaagcaatgcagttgcgacgaaaatctttgccacataaaaatgcactgcaccacattgttattctttgccaggtacaattatttcctcgtcatgtttttaaaaccaaaaattcaagatttcattttggttggctctcattcattgaagacatgtttcatagatggttaagaccgtgaaatttgaatttttgcttgttaattacgtgattgttcttttcttcaagatctgcccaacatgtatcatggtaaatgcttagtgttgtttattgcttggcctcctctaccaccgctttcctatgttccaattggaacatacgctgctgggggtgcatgtgcgtgtgctagggtcgtaactaggctaaatggaatctaaaacgcaggtgaagcatagtatggtcaggaaatttgctgggtttgtaattactttaaggtgccaaccaaccatcactatgctctcatgcatatattcaaactgacaaagactggggttgctccagattgttgcttttgatgagaggaatttggacaaagcagaaatatatagacaataactgcctattaagaatcacaattattatttttcccaattactgatctaatcattttgcttgactgcagcccacatgtgaacttgggatcatctagtttttgtaagaaaattgtaatcatgtcgtacaggtgatgatcatcagacctgataagtgcacttttttcatatgggcatcattgcatggaattctgagatgtagttttgaggcactggtacatgctaggaggctgattttgcctcaacagagagcaaggccatggagcctgttgtggggtcaaggagtcaaatagctcaaatggttggcttatgcctccgcgcccgcatatgtgaggtattgtccgctttggctctgacgctgtcgcacggggcctcatgattttgccttttaacaggcaccccatatgagagagaaggttccaatccatataagccatattcccttttaactcataaccgatgtgggattaaagatgcccccacctataccataacatagccccctcccctccaatcaagaaggagtatgtgtgtggggcaggaagcatttccacagatgacaccaatgttgtggctatgggtcaaggggtcagatagctcggatgattggcttatgcttctgtgcttgcatatgtgaggtattgtccactttgacctctgacgctatcgcattgggcctcatggttttgcccggtccagggtctcaacttggtttcgttgaaggataagggggagagcaaaggatcaaggttaactagtaagttctgttgctggtctagccatttatgccttagaatctgcaatagaaaagctttgcaatggtcgcaaggccataaacccttgtgatgatggaagaaagtgaaagttgttgaagaaactttctacgaagcaacatcagcagcattgccttggaaactttggagttgtgaatattagattttaaatgttgctagaactgcaattctttgcttttactgatcgcatctgtatcttacagagaacaaccaatgatataacattcattctaatccttggaagaagtcagataaaaaagacttgatgacactgatatcttaagagtgggtcaaaaaatttagtacaatgatggtgattaacaggggaagcatccttctttgtcatttcgaaaattcaggcagtgcgagtaccaatagatttatgagtagagcagaagccctcttaattagtattggaatagtaacataaaaggttagcccttatatttatatttgctgaaacttgactagcatgtctgaggatgcacaaccattctagcaaagttatgttggtgaaacaaaatttcatcttatttactttaggaggtttaccttttttttttttttttttaggaggttactttatctgctgcatttcatctgaaagtatatgttgtgctcttctacattagccatgcttatatgacaatgttgagataaaataaatacgctcataaccagtggaactggaaggagtgcattggatgaccattcaaatgaggaagcagttggtgaattcacttctatgtgtagattgctgcaaatgtgcatattgggtccttgcacttgtacgaggaggttgagtggagtaatcatagagtaagacttcttcatgggaaattcctattgagggttacttcactgcttcagaagttccccagaaactcaaatgggtactcactttctaagtatttccttcaaattctttaaaattcatttccttgtatctgaagctgcaccggctcccagttttggcaactaaggtataaagcatgccatacctagagacatggtgtcgaaggatgagcttctcataatgaatcatctgaatacaaaacaaaatcttaaacttcttgcataaataatgtgctcgctttctattacaccttacaaactctacttatttgactgcataactggattgttgactaggccaatatgactgagttgctaatgatatttataagtttttccattagattacagtttcttagatttacttttaggatgtttattgtgtggtagtaaactttgtcttggtacctttaattttggtgccgacaaggtgacaaaatactataaaattactagagattgttggttcttctgaaacagagtgatcagagtttcctcaagtgctcttatcatgactacttattagtataatacgcattctatggggacaaaagacatttttctctggtctctttccttggctcttaggttggtgtagttcatacttttaattgcccaacctaattagagcaaagatcatctttgcttttgtgcactttccttctcttgtctatttggatttacaattctgaatccactaccattctttggtaattttgcttgaggttaggtgcatgtcccctttgtctatatatcattttcttgaactttgtttaaaatcttaaagacaagtgaacatagtaataaaggaaatcaagtaatcttataagagaatgggttgatatcagccacacacagtggatttccagtgtttctgagagtctgataaaaaattcaggtgctacatccacaatagaaaagctttatagttttgaacaaagaccataattgttcaagatattcatcaaccttcttctacttaccttcatacatttatctaggttcaagttctgtaatcgacacctcattcggtgacactggtattgacttgcttgaagattggtcatgcataccttcagataaatcatattcatttgaataatcacctgaatccatgccactctgtccattgcaaaatgctggtctagaaggagcctggagagacacagagttactgttgagcatcacaacaacttgtgacatgttgggtctatcagatggattttcctggacacacaataggccaatgtgaacacatcttaacatttcactccttgggcaatggttgcctaaagatgggtccaatatctccaaaattgttcctttgatccaccgctcccagacctgcatgaaataaattttttcagtcatctaggacagaactccagttgtatttatgcagttgaaaactcacatagttcactatgtcttgagcaaattcagaattagagaaaccactgttctttctgcctgtcacgatctctaaaattagaatgccaaaactgtatacatctgacttgatagaaaactgcccacgcatggcatactccggtgccatatacccactgtaataagatgaatacatcatttaaaacactttttaatcaaccatcattggaatgcataggttattcttttagatggagaatgtataagttatcaagacttgtacatacaatgttccaacaactcggctcgtgatgtcctgagnnnnnnnnnnnnnnnnnnnnccactgtaataagatgaatacatcatttaaaacactttttaatcaaccatcattggaatgcataggttattcttttagatggagaatgtataagttatcaagacttgtacatacaatgttccaacaactcggctcgtgatgtcctgagtttggtccctaccaaaaagcctagccaaaccaaagtctgaaatctttgggttcaaatctgcatctaataagatattgctggcttttaaatcccgatgtataatttttaattgagattcttcatgtaggtacagtaggcctcgagcaatcccgccaatgatcttgttccttttcccccagtttagctgttcgcgcttctcaggatctatgtcatatacaaacttgataatcaattaaggcaatacatattagagtaagtcaaagagggcttgaatgtaagatggtcagagatctgtttcttctgcgctaacataagggttacagtagaaatacatctagatttatttaaaagaggagagcctacatttaaaacaaacaccaaagttctagattcaggatcaagataagttatagttcggctctattatttacgttcattgcacaactttctaaaggtcagttttgtgcgggaagaaattataccaaaaagaatggtgtccaggcttctgttaggcacatattcataaacaagcaacttctcttgttcttccaagcaaacacccagaagccttacaagattcctgtgctggagctttgcaactaaaactagctcatttctgagctctctgaatccttgtaatgagctagttgataacttcttgactgctatttcttgtccatcagatagtagtccctatacagaatcataagagtaacaggaattatatagaaccagaagaaattaaagatatatatagaattgattaggatcaagaagattacatatgataaatttttacattggagcacaattctgttaatattattatagagaaattaatgcaataggctaccaggataccttgtaaactgcaccgaagccaccttctccaagtttgttctcttcggagaagttagctgttgcaagtcgtagtgtggatatatcaagtaatagagactcggcacttgcgatttcctccaggctactcccatctactgaaagagcacagaattttgaaactattatcaaaaatttcttgctgaatctcaggacttatgaaaataagacgagataaatggactaggaaaaaaaattctgaaaatgaggttgctcagataaactgagtcatctctaaatcaagaccaataataggtcgtctctcaaggtggtgacttgtggactgctgcacctagttttacatgtttatcgatggccattggaatcagtaatcaaacaatgcatggccttttttgtcataactcctaaagtaacttcaccttagatttcatccatcttccctcttggtagaacttaactgaatctctccaacaaaaatgtaaggaaaaagagctggatgctttgctaaacaatagaaagcaatgggttacttacagggtaactttacaactggcttcctcctcctccagaagcaaatgcaaattattgagatcagcacgaaggcagttgctagaggtatagcaatcgcaaggaccatacccacggcatttttcttctttcctgcgttgataaatgaccaatttcatctatatttccgtatcaacatggcacattgatgatatcaaaacatgtagctgcgggttgctacatacatcatataagtgcatatttttgtgcatatgtttgtggcacctatgggaatgaggccagtggtattgtgggaaatcattgattagtatttacgctacaaaccatatgattcttctttggcaggcttgctgactagcgttttgggtatgtggattaggtgtgaagcagaacaacaagttccaaaaaggattgccatttaagaggaatcaatgagcgaagttttgcatgttccggggttaataatcagaaagtgatcctatgcaagtgttaaaatgatgcaattatgacagtgtgaactacctttgatcaaacagtaatgtactggtgctacctggcaaacccttaaatactttaaagaaaaggttcgctacttgtgctggtttgtggaaacgacatatgtatgttacggcactagttagccttagtgcctcgctctgttgcttatataatattgctttcgttttgtacaaccggccaataaggaagtgttgatctttacggttacttcaaatcacccaccacttcatattttattcataatcaaccaagaatctgtatgcatatttctggattaatgtttaacatcaaaggagaattctttaagtttcaatcaacgtatcctagactcttatctacttctcaactgagtcaccgttgatatataaactgacgctgttgcaaccagttcactggtaccaatagaaacaattttactccccttaccttcttcattaggagggttaataagtggaggcactacgggggctggcgccagtgtgttccccagcggctcctcaagtctcagggtcgctgccccgtcgaagaacttgtatgtctcgtacctataattgcagctcgctgtgatcaccctccctccctgcttcccctctagctgtgttggtctcggctgaaggatactttggaggcactgctggcactggctgggcgacaggtcctgtgtgcactgcaccagcccatatatctcaggaaaaggagccttggtagaattcaccatctgcccggtggcgaacctcctcgtcgagttggagacggcccaattggtgatcgcgctcataagctcgtccacaatcttgtcgaaccggctgcggtcggtcacgttgttggcgctccacccgaacacccgcatcgaggtatcgacggtcgagaagaagcgctggttggagtagcgaaggaggcagtcatcgtagatgacggtggcacctttgttgtacgcgcagagctggggggcgtcttggattgcgttgctgaggcaggagcggcagacggaggcgttggtgtctccgcggcacatagcgaggccgtagatttggtctgggatctggccgacagtggcgttgaggaagccaccggagagagaagtgttggaggctagggaagggaggaggaggttcatgaggttggactcataggtgctgttggcggtgtagttgccggtggtgccacactgggtgtagaggggattgctggcagtgggaggggaaagtaatatgaggaagagaaggcataggaagaaagggaaggaaacatggcgaaacgataccatggacgatggttgcagcgaaaacacggtggctctggacacggcagaacggagatgttatgtctggctatggaaaccgggtgcgaacgtcagggacctgcgagtcggcgcgttggaaggaagctggaaatgccttgggaaagattgggagcagcagtggtcgactgggtcaaagcgacatcctggactgtgaggcgccattggacgagttgaattatggtgaattaggtttcagtccgcaggcatgcctacgtggatttgatcgataggcgttaagaccagctgcaatgcccttgccaaattacaattatacccagcgttcatgattttgcccaaccaaactagaaacaacccgcaagggccatggaatgcccaccatgtgctcgactggtgttctcacgtttgtaaaattcgcagcctaagtctcacgtttgtcgcggtcaagtctcgtgctaaatatatagcaaatataaacacgcaacattttttttggtaaataacacgtaacctttgtggaagaaaaagaaaggactgattcactgaagccttttagacctgaggaaaggttgttggtcaacatatgtgggccttggaaaactaacaagaaacaagaggatccccttcaaattacggaagaggggaacaaaattactatagtggaccctctagaaagcaggaaattacgaccaggtccagtggacctttccaaatgtcgaggcatgtcccgtagataacaggcgtccctcatttgatcttgagttgtttaaataggagggaaatttggcgagcgactatcacagtgaatgcatcgtgcagggcctttaatatcacaccatttcagctagtttaagaatcttaaagcagatgccataaaagggaaccaatatagaaggttccgttagatcttcagaggacaaactcaccttgtccctccgatctcttcttgatccaactgctgcttgcttctcgttctcgggtcccgtgggtggcatacactcttaatcctgaatttttttcaagatttttctagctttattaaataattatcttttctgataacacctctcatttgatacattgttagtctgaaatctagattaactgggtatgcttcgttccgtcttaattgctatctctttgcgttcccattggctgcagcggaaccgaacgctcaggagacgtgtctgaattccagcagctgtatttttttgacaacgataagcgcttgctgaaagcttgcgtgattcggattgttgcacgggtcgaggggagactctgaatgttcacagccggaaagggatttcatctttggataaagtgatgctcccgaaccctggagctgcaaaggaagttttcaccatatggagttccaatgcaccatggttattgtttaacgtctagaatttatttttgtttgtattaacaaaccaaaattttaacatttcatgtttgttagctctaactgattgaagacaactttcataagatagataatattaaggaccatgaactttgatttttcattggccaattaattgaatggttcgcttcctgaacggttaaatagcaagaggatatgcccaacatgtatcgtgattagtgcttaatgttgcattttgcttgattccctcaacacaattagtattcgttgctacatctggaacttaggcggctgggagtttgtgtgggtgtgtaagttttaggtgttaaataaccactacaatgtgttcatgcattcatgctagctttgaacctcccaaagacagggtggggtgctccagttgacattttggcctaaggtatcacgcctctggcccccaaaaaaatcataataaaaataatttgaaggcctgacagccgcatattgataaaattgaccctatagacatacaaagaggtctatccatcaatgaattcaatataacctaaaaattatacaattcatatataagagacaataaatatcagaataactaaacaattaatccaaaagatcacatatgctgccaataccatcataagtcataccatagggtttttcttctaattttttacaatgaaaaacttttagtatttaagttatttaatacatcaaccaaaaaatataaagatatatatatgtgcccattgaaccagtccacctatctataaaatcggcctcacctttattattccccaaaatgctgataacaagttagttagaatttcctatatctgacaaacaacaagtcaagattgtgatcttcacaactcagtaaataataggtatactttataaaacttattctagtcatattaataatgcaactcaattagcttatacaagatatgatacatgtacatatccaatgtcatagtcatacaattaatggtgtccatatcaaaatcacgtgccatctattctatagtatcgacataaaaaattaataagtcatattaaaatttattacgtgttcaagtatattatattcaaatttgagtatgtatatttttagctttacagcccatgctgcggtgcatttacatccttgtagctcaggtatcaccatgattatcctcatcatgggattgccataatattccaagtattagaaatcatcataatcaccctcgcggtggggttgccgtactatatcccgatggctagttgtcacgacaatcactcccgcatcggagatttatacaatcaagttcagatttaaatacagtagagctgaaagtcaaatgatacatatgaatatatataatttatacatttcttttcttttagatatagcattgaaatatataattaaataggtagtatttagaattttatatgcttgatccaatcataataggtatcactatctagttcaatttacagaattcaaataaccaatcaattatccatatttataagaattcatgcatgtttaactctaaattaatcacaacaactgtatcatttcaaaaagatgatataattttcaattaattttgattaattaatataaaatataaatattatttaccttgcaacacctacaacagattatttaacgcttcacttgggctcttcccaacctaataatcccaaagcatgcatatgtatgtaatcaatgccatgctatagcttaataataatctataaaattttcctaaaactctaaaatctgcattttggggtaaccatcctttcctttgcattagttccattccatgatttgtttatcctaagtagtaacatccaaaaattttcaaattgtgtgggttgattaagcaatgagttgacaactccctattaaattttcagatcaaaatacctagctatctaggagtttaaaaaaaaaaaagaaaagaaaaaagatcctgtatcaaaccaatgaaatatctgttggccttatattaattttaagtaacatcattttctcatctgggcacaacatgtattctttctattatttccgattgcacttctacttttgttattgagttacctgtataaatccaagggacatgatttttagttcctgttttttagtctcacctttacgacatgcttagcactagatgtatccaaaacggatatggtaaccaaggacgacagctaaaatacttaatagtttaaagggttggtatatattcacaagtaatagtctttgatcaaatttcgataaattccaaactgttgtttactaaatagcaaagaagatcaggacaacaattgagatgaaatgatcgacacaacatagaaagaaatataatcccaagggaagtaccaatgcccaaggaaaagaaagaggagcctgatgaggctcccaaaaaataaaacgaccttaatccctctcttctacatgttaataggaaccaacataagaagagcaaattaaggagacttaccagaggcttaagaggaagaaggaaagagaagcacagctgccttgaacactcgtgggagaagagggaacattcgaatagacaagaggcgtgagagaagatgaagaggacgagaatgagtaagagagaaaagggttgagggcgagagagacggaagggagcaagagagaaggaagaaaacagagaaaggatgatgggggtttggagttggatagctagtgaggaaggaaaaacggtgctccgttcttttcttcttttttttttttttctttttcaaacaaaactcaccgcctctcaacaaagtttgttatataatatttagtgatcacagattgctaaagacatgaaagcccgtcagaagtattgaaaactaaaggaacatgctgggtcacaccgaccaataatttcaaccaacgcttattgcctcttggcagcgggttttttttttttttttcaatgtaaatggagaaggaaaatttctgccccagatttcttaaaataagatcgtaaatattgtttagcacataggtatgatagtcatgcaagaaaaacagagaatagggagttacaaggcaacctgagaatgccaaggtgatgtccttttacaagctggggataggcgttgcgttaatagttgttccctgggccacgaagtccggagctgcctcctttcagttcgcttcaagtgccctgtaattgtatatatagttgtattcccccaatcaatggttagcatgcatccttcgcacagttcaaaaaactttgcctacggtagaataaatctaatttgtcccaagttctcagccacgagaactttgatatgatagcacaaccaatcgaaaactttcactttctcaggaatccagggcctccaaattattttcccgagaaagtgacaagattcctcatggctcaggaagtagtggcaatgtctgaaagctgattttaccaattattttttgtgacatttgaatttttattatacataaagaacaaaggactaagtctccctttaaaagctagctatcaaagtaacactttaacgagttgtctagtcgcttattgctttagaaaaagtcaaaacagttgaaactttttttttgatgaaaaaaaaaaaaacagttgaaacttcatgcggattcattgacacttcattcctatactttgaaagacatgcttatataatgaaattaatgtaacaaattgtggtcatgcagatattataaaatgcaattatttccatagctagtggatatctataatttggcagctgggccatttcaagacttccttctaaagtagcgtaataataattctaagtttctgagttagcttttcatgccttggtccccttgaaaatagcaaaatatgtaataatcataactttaaaagatgcgcccctcgaacttatgatttgaaacgcatataaaactctttaggaataatgaaggccaatatctggttaaactttttctatcttgatgttgtaaaatagattgcacgactcagataacataaataatatgattgaatcataaataatatgtttctcccacaaatgtacttgtgagtgaatacagaaaatacttgtagtttatacaattttgttctttagttttaagatggataatcataagagtttgctattttgtctaacagaacctctttccatggacaggattatttttttnttttttttttttttttggagcctaaattgcaggttgtgctagcttcttgctacttatcttggtctcaacgttgatgactgtgaggcttggaaggaaagctggatgccttgcgaaagattggaagtagcagtgtttgacttggccaaagcgagattttggatttatttagagggacgtcacactccaaatccacccgacggatcagcgatgtgacaccacccgaaaattttagaatataatcctagaaaaaagaacatagcgatggtcatcacgttagcgcgttggtggtcctcgcagtgcattttcatccatttatggaggagaagatttttaaaattatccaataaggattgcatacgctaagtttaatttggacggcttcgagacaggacgcaagcacttttctgttgtttaaaagcactaatgctgtttcatggctacatgatattagtgaagatgtggaaaataaagacatcggagctctattttttgatttgggtgcacttagagtcaccattgatggattctctgaggcaaacaaactcggagaagatggattttgattcagtttatagagtataatatagaacagttatattatgtcacgtttgtcacaaaacaatgaaaattttttttcgtcagcaagatttagtactaacatcagcatattagtagcaaaaaaaaaaaaattatctcaaaataaattttgatagacgaaaaaaaaaaaaatatttttggaagaatttttttttcttttgccattaatgtgctgatgttagcgcttatcttttctggtggaaaaaataactttcattgatttgtgacaaatgtgacgtgatataactattataatgaatatttatttgtgaagatagaaaataaaaaaatcaaattttatttttgaatttgggtgcacttagagtcaccattgataacctctccgcgccaaacaaacttggagaagatggattttgatccagtttataaggtacaatatagactgtaaagctgtaacctactctattcctattttatatcgtgaatattgtttccattcaatttaaacacaacactttcttatattttgctgcatctgcaatagagagcactatcaaatggccaggaaataggtgtgaaaagactttccagaagttcatggcaaggaatttcatagttttctaccaaaaaagaaaggatttccagagtccagaaatgagatacttttgtagctaagcttgaacacaaaaatcttgtgaagaaattgggttgttgtttcaaagaaaaaagaaattagctaacttgtttaagaatttcttccgaaaatcatgacacatttctatatggtatgcttggcattcacttttttcgatgctataaaaatcttgcatttttttgtaacaaactgaaactgccaccatgttcctgcattttattatatatatatatatatatatatatatttatataaaagaggtcatctgttctgtctattgcaaccaatcccccatagtccaatcgtcggggtcgcgcacctgcaagaaaggtcttcactgaccggagatgcctctgacggggaccctccgacggtcaaatcagagaggagactagacaacagtgaaaaatcagggcctcagcgggggagaaagagagagctagagagttcaagagcttaaaggcgcttcaaagagcttgagaaaaattctgagagcttgcttaccaaaactgttgccttaccnnnnnnnnnnnnnnnnnnnnnnnnnnnnnatcaaatcgtcggaggctgtgaaatcaccgtgggttgtcaagtcattggaattaatccatgttcttgacaggacaatgccccaggacggtcgtaccacatgtccttggtggggcaatagcccacagtggttgtacggcggttagatgggttgccgactatatgtcggtattcgattgtcgagacgtcgggtagtatctcggagacatcgtcggtcgatctggtatcttgtggaagtcggacatcggctgccacctccgacagtgagtcggtgatatgggttcgaccgttcgatcagatattatcagcagtcattgtcagagtcatttgtccgtcagatgggtagagtcgggtatcggctatcggattgatctaaagataaatcgatgtacaggaattagtcggtatatcccaacaatcattgtccaattcatgagtcctatgtgggagtcgatgattggttggcttgcttcatagtgcgtaccctctcttgcattgaaccaatcaccaacgaccatgtcgaacttgtgaactgagtcggaaatgacttgtccgtaggtagcagtagtttctattttaaaaagctatatggtaacaagtcacagggcattttgggaacaaaaatcatatcagacgggcatcagaatatatatatttttataattttttttaatatttttttttaaaaaataatttttaaaattaaataatttttaaataaaattattagtctcgtaatttaaaaaaaaatatcattttttttattttcaatatatattttttactagtacatattatatagttatataatacacaataagtaaattaatcatgaaacaaattaatacatatttttaaataaattaatatataatttttaaaatataaaatttataatacataatacatgatcagataatacatatttagtaaattaattatttaataatataatatatattttcaaataaattgatatataatttttgaaatatatgtttgtcattatatattacttggtcggataatacatattcattaacttgctaatatatattataaacttttttactacatatttagtagtgatccaatatatatctctaagtaaaaaatatattttaaaaattatatatggatttatttaaaggtatatattggattatactagatgtgtatcaaagaagcttgtagtatgtattaaaaagtcgatcaatgcatatcattaaattatagagtatgaattgatgaacataatattttataaattatgtatcagtttatttagagctatgtgttggattgctagatgactaatttactaagtgtgtatcacctgaccatatactatacgttagtaaatttcatattataaaaattatattttaatttatttaataatatatattaatttttttaataattaatttgtttagtatgtatcacttggccacatgtagtatgtgttagtaaaaaaatatattataaaaattaagaagaaagagaatgtgtgctttttatttttaattacaacaccgatgattgcgttagaacgaaaaatttttgattttttgatttctcttttaaaattaatattaaaaaaataataaaataagaagctcatccctttttttttttttcctctattgcactcccatatgatttttgttcgtatatttttcttaagaaaagacgggtcagatgtatcgtctaagccatataaaaataagctttatataatctcacttatttttagtctcataatctctttatcatagacatcacttcatactattctggaaaacgtgtttggcgtcgagcagccataacaaatagggatcaatacttttgctaattatcttgatatagttagacgaatgacgatcatgagtccagttgcatgccagatttttttttttccccactcaatttggtaattttggttatattatgatatcattttacgggataatcctgaattaagcaaacaacgtcattcttctgtctaatttcatcactatggtattattatatgctttgactaggttttacttggatgatacagatcccatcaaatgtggactactagattgggggaagagcgataacattattgggtacttttcaaataaatcagatgtttttagctttggagttttagttctagaaattgtgtccggtcaaagaaccagcgacttccgtggttcagagaattctacaagacatgaagcaaaagttagggattataaattgccttccgtaatctctccaagcttattctttcatcatgactagtcttgttgattgtttgttaaacaggcatgggagcactggagcaaaggaaaggccctggaataatggatccctgcgtaggtggatcgtaccataggcaagaagctctgacatgcattcacattggataattctgtgctccttgaagacatgaggaagagaccttgcatggcatcggtggttctctcatgctaagcaattactctgcgactcttccaactccaataactgcatacttctttgttcgaggtagaacaaccgctgagtgagattacggctttgagaactaccgatattgattccactctatctggcttgttatctatatgcaacatttcaattaccgaaatgggccccgttgagaaattgggtgcaaatttggatattttatcattgatgagaaaaaggataagcttttcagaggaggctgacgatagatcgaactaagaatgaatacactgtatcttgtgtttcttttttctttcttctctacaatatgaagcaatagtaagaggatgatgtgaacaattaaataaaaaagttacaggacatatatattgcttctgttgagtatctatttatctcttattataaatatttgatcgtgtgattttttttcttttcttttttttcttttttacattgctgctttcctttttttttcccgtagaagaataatgattgggcgttggaaacaccctctgttgcatgcctccagggcacctttcactttgtctgagcccgttaacgtatgcggctcatattattttttcctggtctgatacaacggttgctgtaaattattatacaaaaacattataccacattataacaacaaagatgtagccaaaaagaaagccatggaagaaggccactataacaacccaagacttcactcaaaaaagataatcaaaagatattatttgaattttctgatcctatataggtattcaaaatctttctaacaaataattgatatgaaattaaatatatgtccatatagatcctcacaatcactatggtggcatccataaggatgactttgagggtaccttacacctccaatgaaccccctcatcactcactttccttaggtgtcctcagtgccacaaattcgaacctgctcaccgtctccttggatgttattgttacaaatgtcttcttctaaaattaatttgatattattcaccaaaaatagtttgtacttgttaatggttaaggatatatatcaatttataaaatataattaagtttggcatcatgccacctttatcaaattgcaaacatattggtgaatatatatatatatatatatatatatatatattagtaatactatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaagtttggcatcatgccacctttatactaaattgacaaacattattggtgaatatatatatatatatatatatatatatatatttgaaatctatgcataccaaatttaaatttaaacaagaaaatatacagtactaagagttttaaggtaactatatgttaaaaaaatattggggcgatttggtgatataaaaatgagaggatgctggtcaatttgttgcagtggaagtcaaggcatcaatttgcatacgaaaagaagagcaaagaagattagtggagctggtctaatccaagattttttgatatttaagtcagacagaactttgagaaatagaatagatatgtagaaacatgaaaaagaaaacgaagtcgagagcttgtagtcttcccttatcactaattatagttggaccttgagcccgttatgaagaacccatgtcctattaaagtggggctctaaaatttatagtctaatagggtgctgatttgttgttttccttatctagaccggtccaataatataattctaactgaaactgatcatctgttatgtcatgtatcaatttacgattggctgggccaattttggccgtatcaaaagtctttttctttgtagtgctccggttttggctatatcaaaatcctttttctttttctgctcgtgcatgctttctttttcaagcatgaatttgtctagcatgggaaatatattaataatttaatccatacccaagctatagatcgttgaggtctcacaaatttcacttatgcagatcgtaaaaaactcacacccattgatggacaaatagagttctgaatcaaaagtaagacctacactcttaaaggatcaataattgagtcgacgtgtaccctcagccaacttgacctggtgctaactcgtagagattttttatataatatttcagcatgacgacaccaatgctatgaaaaatataaagttcatgttaattatctttttagcttgtagaatcgcaaatgatccaagatgctccaaaacagcttagcattggcttaatccagacttagacaaacagctgagctccaacaagttttggagcttgacttataaatgatgaacatgagtcaacaataaaatcaataggaaactcgattcatttctattaaatcttgggtcacagcatatctaagttgaggttgaacaaacaagaggatatgaggatcagggcaaccctttgtttgtttttttttttttggtataagcaggccatagtgtccaaaaaatcagagtataaaatgtcccgtaggatccgagagtagtcgacaccttcattccagatacagttttcgatgtactcggcaataaaagaagcagcccaatctatcatgctattcacctttcagaatatgtgtcggacagacaatgcgatggcatgatgaaggaacctccagataacgtagagtagtggatgagtctctagtgtttcgtctcatcctaaatccagctgacgactataaccaagtcaccctcgatgaagatcctctcagcttgcaactcatgtctcacacaaatgatgcccgtccaagtgatatggggctctgtcccagaaacaaatgggtcgaagatatgagatccctcagcagccaacaacctagtatccggaccctggatgacatagctcgcactacctttgccatctctgatattgccgtcaaagttgatcctaacaaaccccgagggtgaaggctctcaagaaatgaaaagagtcctttgagctgctacatacaagtgcaataagggagttctaggaacttgtgggattaagggacatggcagcagtattaaagcaataagacttcttagctaagcaacgagctctctccaccatccattgtatagacgcaactttggcttcgaaaatcaagctgttcctggatagctagatctgataggtggtgtaagccatcctagtaccctagagcgacctcttgatcatattttggtggatagtaccgcacccaagaagaacaaaagccatgggctactatcagccccccaagtctggccacctatcatctctcaaattaggcatgccctcagataacaaagtaaggcatgctccatcaattcatcctttaatttgcagattggataggatgcaggaagattgatgcttttgtctctaagaaatgtccgagtaagtagtcgattccagacagccttctagaagaaaagtttgaccttaagatgggcagccacacactaaatccaagtagctttgatcattttcttcgatactaatctgcttgttatagcgagatctctaatagaaatcttgggataataagatcgaccccataccctcaaatcatggctcccatagacatgaatcagaatagtaagaattttatccacaagcaagcctctaaaaagatgaacgacatcctaagtcctctaaccttagagcaagtttttgttcagtgataatcacttattcttatctacattttttttagaaaagatattgtgtgatactataccaaatgtgtttgactttgactctaagcatccttaagcagacttgctcttttggataggctggattgggcttcggccaagctcatcctaacgaaccatatcgatttgttagtttcggatctgatttgatctgagccttagcctacttttcaaatccgagtttaagtgactcacgctatctttctatcctgttgttttcaaatccgagtttgggtgacttaagttatctttttatcccgtggtttccgcacacacacatataataataataataataatattttataaaaaaatattagagtattattaattcaaattttcaaatgaattttgtgtcacttggagttgttgtattcttttacatttattgtcactaattttaatttatttatcaatttttttaattaaaaatttaaaaattatttatttattaatattgtagtccatctaaaattagtattaactttagatacataatatttttttattcattattacatctaaataattaaaaataaaataataatatttaaaaaattatttttatgtattcaacctcatataatgtgtggatcttcaactaattaaaatattataatagtaattatctctcttacaaccgtctccgtaacaaagataaactagtctgttaaactatatctgctgtaccatttcagtggtatatcatatcagtctattttcgccgcgtggttttttggtttttgctttcgcgggggaggagctcagcttaagaaaaaagctaaaattaaaaggaggaagcgcttcccggctcctctccgcctgctttcaaaaccttggcacggacggggaatatctggcagagtgtactgctgcccgactctagccttcgacgaggagttcgccgtgaaatacatcgacaaggccctcttctacgaccctctcaaccgcgatctcgccctccgcgaggcccagatgcaccagcttgcctccgtcggaatgctcgcgccgtctcgatccacgccacctacgagggcgtcgactccctccacctcgtcctcgacctctgcctaggccctgatctgttcgcccgcatctgcggccgtgccccactctccgagcatgaggtcgccgcaatgatgctcccgttgatggagatgatcaccacaggccaccgtcggaggatcgaccaccgaggtgtgaagaggggttcctatcatggagcgctccctttctttgtttcgttcccttgagcgaaggtggccagaatagccatgtggcgaaaatttccccttctttcgcatcttttcgaatctaagatctccggcgtcctacgcccgatggcgacggtaggcgaaacatctgacctcgtctctgcaacctcttcttgatccaaccttcgcttctccttctgtctttttcttccccttcccctctttcccggtttcttgattttcttgaaatttggatttatttttctccctccgttttttcacttcggtatccagaattttattcgagaaagccaatgtacatagttagcccgaatttctttattttattttattttattttattttattttttctattgttaatcctacctcttgtctttctcagatttggattagggttgttacataattatccctttgtaaccccttttagaatgacatattgttggtctgaggaacatgaacatgatagatatgcttcgctggccctgatattttgcgttttctttggccgcggtggaatataacaccccgtcactcctccttgaattaaaggagttgcatttctttgacaatgggaagcgtttgttgaaagctcagcttcgcttgcgttcagggaaggagcatgtcaacggccaggaagagatcccgttcccagagagaagcaatgcagttgcgaagaaaatatttgccgcataaaaatgccctgcaccacatggttattctttaccaggtacaatttatttccttatcatgttagtaatgctaaaaattcaagatttcttttttgttggctctcattcattgaagacgtgtttcacaagatagttaagaccgtgaaatttgatttttggttgttcattacatgattgttcttttcttgaatggtttagcagcaacgagatatgcccaaaatgtatcatggtaaatgctgtgttgtttgttgcttggcctcctccgccaccggtttcctatgttccaattggaacacacacggctgggagtgtgtgtgcgtgtaccggagtcgtaacgagtctcaatgaaatctgaaacatgggtgaagcatactctggtcaggaaatttgctgggtttgtgattgctgtaagctgccaagtgccagccaagcatcaccatgctctcatgcacatattcagacaaactgacaaagactggggtttgcttcagatgagttctttgttgctttcgatggaagacaacttgacaaagcagaaggatataaacaatgtttagaggctgatctgaaaactggctattaagaaatcacaattattatctttcccagttcctgatccaatcatgttgctcgactacagcccacatgggaacatttatggaatcatccaatctttgtaagaaaatttgatcatgtagtacaggcaacgatcatcatacctgatttcatatgcacatggttgcaagtatggccattcaaattaggaagaaaccggtgaattcacttctacatgtagccggcagctttagattgctgcaaaagtgctccatgcacttgtttgaggaggttgagtgaagtaatcatatactaagtcttggtcatgggaaatttctattgagggttacttccctgcttcagaaattcccccgaaactagaatggatactcacttcctaagaatttccttaacattctttaaaatttatttccttgtatccacagctgcacctgctaccagttttggcaactaaggttcaaagcatgtcatacccagtgttatggtgtcgaaggataagcctctcatcatggactcatccgaatactgaacaaaatcttaaactttgcgaaaatgatgtgcttgttttctattacaccttccaaactctactcatctgactgcataacttgattgttgactaggctgatatgactgagttgcttatgatatttataatgtttcccattagactacagtttcttaaatttactaaattttaggatgtttattgtgtggttttatactttatcttggtacctttattttttgggaccaacagggtagcaaaatactatttattagtgatcgttaattctcctaaaacagagtgatcagaatttcttcaagtcctcttatcatgcctagatataagtataatacaactattatctggacaaaagacatttttctctggtccctttcctcggctcttaggttggtgtagttcatactttaattgcccaacctaattggagcaaagatacaatcgtgtatccactaccattctttggcaattttacttgaggttaggtttatggccccttctctgtatatcattttcttggactttgtctaaattctgaaagataagtgaacatcttaataaaggaaatcaagtaatagattttgtcttataagagaatgggtagatatgagccagacacactagatttccagtgtttctgataaaaaattcaggtgctatatccacaacaaaaaagctttatagtttcgaagaaagactataattgtcacgtcccaaatccgggacataatacggccatgctatcaagaggtaccatcctcaataactcaaaatctatcaattataatcgactaaaattcttcataaataaaatataataaaagatttaatttcattattcatgaaataattaaatcaaaattggttcagagtatctaaatctaaaattaaatatcaaattcatatttcaaaattcatcaatcgtttattttatgtccataatcatcctataaattatgattcggctgcaaaatttccaagctcgctagtatagaccttcaagtctggatgatctttcgtttctaatcttattcatctgaacagaaaaagaaaaagaaaaaggtataagctacattagctcaataagtaaatcttatactattttatccggatcaagcataaatttatacatgcatcaataaatcatttaaagaagataatgattattgaaatataaaactttcataatagtatatcataaataaatcatagtcttgcatatgcataaatcatgcaattttcctaaacatagtttctaatgtcattttactatcaatcataaaattttaaattatgttaattttatcaataaaatcataaatcatttgtcattttatcatatcatgcttcttaataattctttcagcgtaaatactaaggtcactattatacccatgacaggaccataattatgttataccaactattataatctattggtgagggccatatgtctagctactataactcgctggtgagggtcgcatacccagctactgtaactcgctgacgagagttatgtgctaagctactgtaacccgctggtgaggaccgtatatagctatctgagagtccatagtcatacttcttaaatcaaatttttttaaagcaagcatttttaaattctgcttcattgaatcttactttcttgaatcctgcataaataaagtacaagataattttatagagctcatagttaataaataatttttaataatcaaatattcatgaaatcattcttttcgtaataaggcatacatttcataaatatggagtttatatttcataaaaagtcattcatattagaatagccataaatcattattttattacgagtcatgaatttcataatgcacatgcttgatttttattttaagaaaatatagaataattcttttcatgataaagtagttgataatttcaaaaacaaataagaagtgtccggattaattacctttttttgtcccagctctttaagctttacttgatgaatttatcaaacctatttaatatattaaaagcataattaatttttattcaataaattcaatcacaagaaaagaaaactacagattgagtggtcggttcaacagcctatccggacatcagggtaatatagggcctcttaactgagaattagatctaagtgactcaatcaagaaattatgaagcatggattggaatcaagaccaaaatcaatcaacatgattcatcaatagagaatttcaacgatatttgacatggtcaggatgggatccgatatcttgcacagatatcgaagcaatactgggcctctttagaaaaattattttgagtttatattggggtctatggatcaagtagaaagagaaagatggtgtagagagaaaaatcctaaagaagagagagagataagagagggatcccttctctctctttctttttctttccttttcttctcttttcttctcttcttcttttcttttcttcttctttttcttggccgagcagatgagggacactgatggtggttcctgactagaagactagcatcagatcatgacagtaagtggctgacagtggtggagcaaaagacggccggtgacaaagactgatcggtgggaaaaacatgggaaagggcctaaaaataggagatccgagggcttttcatcattttggctgttggctgctcgccaatggccatgattttgtcatgaagggtcatagggaggctgagggctatgatctagagatgcggtaccatggatggtggcgttggtggtcgacaaaagaggaaaaagggcttagctaaacagagaaaaaataggaccctttgtttttttctttttttttgtgttttccggcgaactcgtcggccactggttgtgcgtagaggcacgggaagaacaagaagagaaagagaaagaggggttcggcttaccttgaactccgatggattttctggcgatgattttgggcagacaaaggtcagggcatccgtggcttcaacggaaagaaaatgaggagaacaaagaggaagaaggtcagtgtttatcatggacggctttgaaggagggaggaagggatttataggatggagaggaggatgaatccaggtaggatggagaggaggccgattcctttctggattcgtcttcctcttcgatgggctcgtgtggaagaagattcccaacgggagtcttcaacattcttttttttctctattttatttttttattttcttttttatactttaagattcgtgtaaggaggggttttaggaatggacatcacattctactctctttaaaaataattttgttctcgaaacttagcataccttcatttttacatcagtaaagatgcttagtcttcaaatcatcctcgttatacttttgctatgccactttcatctaagctatacttctagatcttatattctgaactattttttattaattggcttcatctttcaagtaatacaattttcttcttttttttttatttttcagtacaaattcatcatgaatattttataatagaaatggctcattcaatttctaaaatagataattcaaagatatagtaaaccgtaaaagaatggaagagctataatcaatattcatatggacatctccttaaattggttgaaattgtatctgtcgcaatattattgctcgttgtagtatcctgtagagtcaaggcagatattcatgcattctttttttgtacttgttcaactaaaccaacagctttggagtcatttgttttcttattaggacattcttatgccaaatgtccccacttgtcacacagataacatgctatagcttcttaagataaggatcatgatgatttttactgcaatattcataagtctctgttttctttttctttttagagttgttctctaggtttcatgtcggtcatcttgagtttctattggtttagatctcttcttatttgtccttttttgctttgatcttttaatatccgattcaactttcaaagcttatttcaatgcatccttgtagttgttaaaaagatgagaggataagcaagatcgaatcttatatcctaaatcatgctcaaatctatttgctttgcttctttcaaactctgtgagctgggagcaaaatcgacctaattcattaaatttgtttgcatactctagtactattatatcatctttttgcctcaaagtcaagaactcattctccttaactaatctcactgactttgaaaaatattgatcataaaatattttcttgaattcctcccatatcagttagttatcaatattcccatatgcagtatttattgcagcctaccaaaactcagtattttcttttagtatagaaatagctagtctaacctatacatcctcaagatactgtagtgcatcaaatatcttttttattttttaaatctaaatctctgtaatcagagggtcaggtccatcctcaaataatagtgggttaagccttctaaacctttcataatatgactctaaagatggcgtaggtcgaaaaatagcttatatctgctgttgctgaagaaggtgggttactatctgacatactccagcaatgtttgcttgagttactggggtattaggagcctgctcaactgactggttggcatcttccttcataatccttcttgctcctctcctcctagtagcatggttcgctaagaccatctctcctgttgtttatcattatctatcaaaaatattgatattgctcatcattacctatctaaaaaaatttatatattcttattcaattaaatatgatctagctaaacgagatctaattatccattgctagattttaagttctatctatgatcaaacctattgctctgataccataaaatgtcacgtcccaaattcggacataacatgaccacgctatcaagggatatcgccctcgataatatgaaatctattaatcataatcaactaaaatttttcataaatagaatataataaaacattcaactctattattcatcaagtaattaaatcaaaattggtttagagtatttaaatctaaaactaagtaccaaatccatatctcaaaattcatcaatcattcattacatatcaataatcattctataaattatgatacagctgcaaaatctccaagctcgctagcatagaccttcaaacctggatcatctttcatttctaatcttatttatttaaatagaaaaaaaagatataagctacaccacctcagtaagtaaatcttatactatcttactcgaatcaagtataagtttatacatgcatcaataaatcacttaaagaagatgatgatcattagaatataaaacttttataatagtatatcataaataaatcatactcttgcatatgcataaatcatacaatttttataaatatagtttttaatgtcactttactatcaattataaatttataaattatattattttatcaataaagtcataaatcatttgtccttttgtcatattatacttcttaataattctctcagactaaatgttaaggtcattattatatccgtgacaaggccataatcatgtcatgccaactattataactcgttggtgagggtcgtatgcctagctactataacctattggtgaggaccgcgtgtctagctgctgtaacccgctggcgaggaccaggtgcgaagctactgtaatccgttggcgagagccatatgccaactactataaccattggtaaggctgtacatagctagctgagagcccatagtcgtacttcttaaatcagattttcttaaagcaagcattcttaaatcatgtttcattgaatcctattttcttgaatcatgcataaataaagtactagataattttagagagctcatagtcactaaataatttttatcaataaaatattcatgaaatcattcttttcataacaagacatatattttataaatatagagttcatatttcataaaaaatcattcatattaaaatagtcataaatcattattttatcacgaatcatgaatttcacaatgcacatgtttgatccttattttaagaaaatatagaatatttttttatgataaaattattgataatttgaaaaataagtaagaagtgtcagggttacttatcctttttccatcctagctttttaagcttcacttgatgaatttatcaaacctatttaatatattaaaagcataattaattcttattcaataaattcaattataagaaaagaagactatagattgagtggttggttcaacagcttgtccgagtactgagataatatagagcctcttaattgagaattagatataaatgactcaattaagaaattattaagcatgaactggaatcaaggccaagatcaattaacatggttcatcaatagagaatttcaaaaatatttgacataaccggaatgggatccgacatcttgcatgggtatcgaagctgggcctctatagaaaaatcattttgagtttatgttggggtccgtggatcaattagagagagaagatggtgtagagagaaaaatcttaaagaagggagagacaagagagatcccttctctctctttccttgtcttctcttctttttttcttttctctttttttttggtcgagtagaggagggacacaggtggtggttcttggtcagaagatcgacagtaagccatgatagtaagtagccaatggcggtggagcaaatgatgatcggcgacaaggaccaaccgatggaaaaacatagaaaaggacttaaaaataggggattcgaaggtttttctttgttttgactgttggccactcgctagcggccatgatcttgtcgtggagggtcatagagaggataagggccatgatccagatgtacagcatcaggggtggcggcgccggtggccgggaaaagaggaaaaaaggctcagctaaatagagaaaaaaatcaggctctttatttttattttattttatttttttgtgcttttcgatgaatctgctggccattggttgtgcacagcatcggttgtgcacagagacatgggaagagaaaaagaaagaggggtccggcttacctcgaactctagtggattttttggtgatgattttgggcagacaaaggtgagggcatctatggcatcaacgggaagaaaatgaggagaacgaagtaggagaaggtcggtgttcatcgtggacggctttgaaagagggaggaggggatttataggatggagaggaggctgaatccttcctagattcgcattcctctctgatgggcttgcatggaagaagactcccagtgagagccttcaacattctttttttcctctattttgtttctttttcatgccctaagattcatgcaaggggatggagttttagggttggatatcacaataattgttcaagatattcatcaaccttcttctacttaccttcatacttctatctaggttcaagttctgtaattgacacctcatttgctgacattggtattgacttgcttgaagattggtcatgcgtacctccagataaatcatgttcatttgaataatcacctgaatccatgccactctgtccattgcaaaatgctggtctagaaggagcctggagagagacagagttactgttgagcatcacaacaacttgtaacatgttgggtctatcagatggattttcctggacacacaataggccaatgtgaacacatcttaacatttcactccttgggcaatgtgtgcctaaaggtgggtccaatatctcgaaaattgttcctttgacccaccgctcccagacctgcatgaaatgaatttatttagtcatctagaacagaaaatacaattgtatatatgcagttgaaagctcacatggttcactgtgtcttcagcatattcagaactagagaaatcactgttctttctgcctgtcacgatctctaaaactagaacaccaaaactgtatacatctgacttgacagaaaactgcccatgcatggcatactccggtgccatatacccactgtaataagatgaatatgttatataaaacactcttcgaccaaccatcattagaatgcatagactattcttttagatggagaatgtataaattatcaagatttctacttacaatgttccaacaacccggctcgtgatgccctgagtttggtccccaccaaaaagcctagccaacccaaagtctgaaatctttgggttcaaatctgcatctaataagatattgctggcttttaaatcccgatgtataatttttaattgagattcttcatgtaggtacaataggcctcgagcaatcccgccaatgatcttgttcctttgtctccagtttagctgtttgcgcttctcaggatctatgtcatatacaaacttgataatcaattaaggccatacatattagagtaagtccaaagggggcttgaatgtaagatggtcagacatctgtttcttctgcactaaaataagggttacactagaaatataactagatttatttgaaagaggagagcctacatttaaacaaacaccaaagttgtagattcggtatcaagataagttatagttcggctctattatttacgttcattgcacaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggaatccatgtgcaaacttttcattctctaaggttggtaatcagcctgtgatcctaaggaattgttaatttggtgtaagtatgatagtgtgaactacctttgagcaaacaattatatactggtgctagccggcaaaaccttaaaagtaaagaaatggttcgctactttggctgatttgtggaaataacctttgtatattacagcactaggcatcagtgcccactctgttgcttacataatattgcttttgttttctacggcaggccaataaggaaaggctgatctttactgttattttagatcacccaccacttatattttttcacgatcaaccaagaatctgtgtacatttgtagactaacgtttaataccaaaggagaactctgttaagtttcagtagacagatcctagattcttatatacttctcaactaaattacggagaaacgtacgtttagcacaaaaaacaaaaagaaaatgaagccataaaactcaaaactgataggatattagtaaacagattagaaatgactggatctcaagcagagtagaaaggactcatctattccctattaagtcaccgtcgataaaccgaagctattgcaactagtttgctggtaccggtcggaaaaatcttacccctcttaccttcttcattaggagggttgataggtggaggcactaacgtggcaggcgccggcgccggtgagttctccagcggctcctcaagtcttagcgtcgctgccccgtcgaagaacttgtatatctcgtacctaaaattgcagctcgctgcgatttccctccctccctgcttcccctctagctgtgtcggtctcggctgaaggatactttggaggcactgctggcactggctgggcgacaggtcctgtgtgcactgcaccagcccatatatctcaggaaaaggagccttggtagagttcaccatctgcccggaagcgaacctcctcgtcgagttggagacggcccaatcggtgattttgctcataagctcgtccacaatcttgtcgaaccagctgcggtcggtcacgttgtagcggttccacatgatccaggacggtgaggtgtcgacggtggagaagaagcgctggttggagtagcggaggaggcagtcgtcgtagaagacggtggcgcctttgttgtacgcgcagagctggggggcatcttggattgcgttgttgaggcaggagcggcagacggaggcgttggtgtcgccgcggcacatggcgaggccgtagatttggtctgggatctggccgacggtggcgttgaggaagccaccggagagagaagcgttggaggcaagggaagggaggaggaggttcatgaggttggactcataggtgctgttggcggtgtagttgtcggtggtgccacaatagtagtggaggggattgccggcagtgggaggggaaaggaatatgaggatgagaaggcataggaagaaagggaaggaaacatggcgaaacgaaaccatggattacggttgcagtgtgaacgcactatctctgaacatgttctgatgttaggtatatctggctatggaaacagggtgcgagctagagggaaccatgaggcgacgcgctgggagggagcaggaaatgccatggaaagattgggagggacaatggggttttatttagagatttgccaggcccgcgaggacaaattatggtgaattgagaaatgctttgtgcaccgcggggctcacacgcggggccagaacgcggcgtccgaagatttttttttttttcttccagccccgcggcatggccatatggatttgatccataggtgttaaggctagatacaatggtcttgccaaattacatttatatctcagcattcatcattttgcctaattaaatcagaaaaaatccacaagggccatggaatgcctatcatatgatcgacacgtgttctcaattttgcaaaatttgcaacctaaatctcacgtagttccatgctaaataaataaaaaatacaaacacgcaaccttcgttgaagaaaatgaaaggactgcagccttttagaccagaggaaagcccgttggtcaacatacgtgggcctaggaaaactaacaagaaacaagtggagcattatttttttgattgaaagggacgtgtaaactacccggcttttattatgtaggagcaggagcatgcagaggaaaaaaaaaaaaagtctgcctggagcttaggcaggaagcagttatttacatcttggacttatttttgtcagcgttgacagacaaaaattttacaattgcatgtttattagctctaattgattgaagagaagtttcataagatagataatactaaagaccatgaactttgatttttcgctggccaattaactgaatggttcattttctaaacggttcagtagcaaggggatatgcccaacatctgttgtgattggtgcttaatgttgcattttgttggattccctcaacacaattagtattccgtgctacatctggaacttacgtggctaggagtttgtgtggtagcctaaaagatacctgagacatggatcacatagttgccggtcacaaaatttgctgggcaaatagtaagttttagctgtcagacaaccactgctttgtgttcgtgcattcgtgctaggtttggacctaaagaagattgggtggagtactccagatgagctttttggttgccttggatcgaatgaacctttctttctttcttttttttttttaactcatgggtcggttgttaactgattaaatcataactaccatgtgaaagcagaaaaatgtaaacaaagtcaagtatttagcgatcacaaattgcaaaagatatgaaagcttccactaagagagaagagagagagaggagaaaacaagacagagaataagaaaatatttggttaagcccagcacagcaccgtttagcagcattctgatctcccgagtagtttcagcattgttccggaactgaaaagcataggttcagcagagttccagtcaagtttcagtagacttttagctagccacgggtattgaaaactgttgggatataccgactgatttttttcacaccgactcaccttcgggcatgcctgaccggcgtccgactctaccgattgcaccaaccaacgactgtcaacactgtccgatcgaaggtatgtcggtcggacggacccattctgttcctgactagacgaacggcggagtctgactctaccgactcactgtcaagcaggggtagtggccgatgtccgattcccacaatgcgccagaccagccaatggtgtccctgggtcttcgcccgacgtcccgcaaccaaataccgacgtatggtcggtcggctcctccaaataccgtacgactgctgagggccgccgtcctgacaaggacgtgcggcatagccgccctgggacattgtcctgccaaggacatagattaatcccagcgatttgacagcccacggcgacttgacagttcgcggtgattttgacagcctccgacgatttgacaactcccccagttgtctgcgccattaatgacggcaccacgccgcgctctactataaaacggggaaggcaacagtgctgcgaggaggttctttcgaagcccctggactcactctctctctctcgctgagttctcctgattcttttctactgttgcctagtctcctctctgacttgaccgtcgaagggtccccgccggaggcacctccggtcagtgcagatttctcttgcaggtgctcgttcccgacgatcaggcgacgaggagattggccagaacaggtttggcgcgtcaagtagggggtatccgacctctacagagcttgaaaaaattctttcaaaatgacaagaatcagggctcagcgatcgagggccaccggatcggcgaggcactctttccatcgagaagaagcctctcctccgccctccatggcggagcccagatctccgcatcctgtggtgaccacggaggtgcaaatcacgacgattgtgcggcagatgactgtgctgacggatgcagtcaagagccttcaacaacaatcgacccggttgccgcactcgccggtggggcaaccggcggcgcacccgatgccctccaggagcagccgccgacgcccgcgtcggtctttgtctcctcctcaagagcagctgtcacagcactcccaccgagagggggagaggtggacacggcatgatatccatcggtctcgacgaccctctccttcccaattggaacgagcgaggaaggagaagcggccgcggacaccgtccgcctccccctcaaattcgtcgggagactcgacccccggggtctcccagcaccaacggactgacaactacgaatgcaggttcgaagaaatcgaccgtcggcttgctcagcttcaggtggacggacagaagtcctcgaacgatgttgacttccagaccgcccaacccctctcccgactcatcctagacgatccgattcctagtcggttcaagatgcctcatgtggagccctacgacggctccactgatccggttgaccatctggagagctacatggctctcatgacgatccaaggggcaaccgatgcccttctctgcatcgacttccccaccacgcttcgcaaggctgctagggcctggtactccggcctccggtcagaaagcatccactccttcgaacagctcgaatatgctttcgtggcccatttcagcaccagccggaagccgccacgaacctcgaacagccttttttccctcaagcagggagaaaatgagacgcttcgatatttcgtgacacgattcaatgcagccacgcttggggttcgggacctcaacgaagacatggctatttcagccatgaagagggagctaagggggtctcgatttacatactccttggacaagaccctctcccggacatatgccgaactgctggagcgcgcgtacaaatacatgcacgcggacgaaggagttccgaccgatgcctgattgaggccaagggctcgaaggagaagcgaaggaaaggtcgggcccctgccgagcccagtaggcccccgaccgacaaacaggtctcaccccagtgacggagcccgagatcgcctcgacggtggagtccgaggtcgatgcatcccaggtatgactcctatactcccctctctgctcctcgtgcacagattttgatggagatgaaggggaagaatatctacgacggcctccacctttgaaggcaaagggccttgaccgacgaaagtactattgatttcatcggggccatggccataacaccgagcagtgtatccaacttaaggatgaaatcgaggccctcatacgccgagggtatcttgaaaaatttcgaaggaaaccgccgactcgacccatccccgaccgacgaccccaatcgactgaggaggcagcgaacaatcagcccacggtcggggtcatcaatatgatctccaaatgactggacccagggacgactgctggaggggagtcgatgaagaagctacgccaagacgatgtaattacttttacagatgaagatgctcggagaatccaaactccccatgatgacgctgttgttgtctcggcaataatagcaaattatgatgtaagaaggatctttgttgataatggaagtttgactaatattttgttttactcgaccttcttccgaatgcgactgtcggctgatcggctcgagagagtctccatgcccctggtgggtttcatcggggaggccatcacggtggaaggagaagttactcttcccgtgacagctgaaaccgaatcacgataaagcaccatctacctgaccttcacggtcgtccaagtaccttcggcctacaacgccatacttggaagactcgggctaaacgccctcagagctatagtctcgacctaccacctgctggttcagttttcgatcaaaaatggagtcggagagatgtgcggggatcaacagctcgtccggcgatgcttccaaatctttgctcgaagtaacgaagcaaaggactccctgacggtcgacaagttggactagtggggagaggaagaatggggcgaaccgaccgaacagctggtttccgtcccgatagcggagaattccgaacgagtggcctgggtcggatcccaattattcgaccctgagcaatggcagctagtagagctgctgaaagccaatgccgacgtattcgcttggtcggcagcggatatgtccggcatcccctcggagacgatgactcaccgactcaacatcgaccctggaatgaggtcggtgaggcagaagaagcgttcttttgcccctgaaagacagaaggccatcgacgaggaagtggacaagctactcgaggcagacttcatcagagaaatcacgtaccccgattggctcgccaacgttgtcatggtgaaaaaagccaacgggaggtgaaggatctgcattgactatatcgacctaaatcgtgcctgcccgaaggacagcttctcacttccgaaaatcgaccagctggtagatgcgacgtccggacattgactgctcggcttcatggatgcctttgccagatacaaccagatccagatggtgcccgaagacgaggagcacatagcctttgtgaccgtcaaaggcctttactgttacagggtaatgcccttcgggctgaaaaataccgaggccacctactagcgactcgtcaataaggtcttcaaagactaaatcgggtgcaacatagaggtgtatgtggatgacatgctggtgaagagcacgcaggcttcagatcatgtccaagacctcgaagaaactttttgcacccttcgacgacatcggatgaggttgaattcgactaagtgcgccttcggggtgacttcgagaaagtttttcggattcttcatttctcaacgaggaattgaggctaaccctgagaagataaaggcaatcatcgacatgcggcatccgagcacgaaaaaggaggtacagcagcttaacggaaggatcatcgcactcagccgattcatttctcaatcggctgagagatgcctcccgttcttcaagaccctgaggcaggcgaaggacttctcttggccggacgagtgccgataggccttcgaggatctgaaaaggtacatggcctccccgccgctgcttgtaaagccagaagtcggagaaatgctgtatctctacttggccacctccttagaggcggttagctcggtgctcatccgagagaacgagagtcgaattcaccaacccatatactacaccagcaaaatgctctacgaagctgaagctcggtactcaaagatggagaagatgatattcgccttgatcgtgtctgcacaacgattccgtccgtatttccaagcgcacgctatcgtggtcctcaccgaccagtccctgagggcgattttgtgccaccccgatacatcgggacgactggcgaaatggacggtgaggttgagtgagttcgacattcagtaccgaccatgacctgccttgaaagcccaggtcttggctgactttattgcggagtgtccgacaaccgaccaaagatcggaaggcgggagctccgcagaagctgcaatctccgaacctgaccccgggtctacttgggtttgcacatcgatggancttccaatgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatactacaatgctaaggttaagccgaagcttttcaagcctggggatctggtcttaaaaaagacagaagtttcaaagcctctaggataagaaaaattggctccgaactgggaaggaccctacaagatagcggacatctacaggccgggagcctaccgactggagactctagaaggaaattccattccccagacttgaaataccgacaatctgagattgtactacctgtaaactctgtgcgcccttgttcggaatacaaactcagcttcaaaacttcagagtctagaatctcagctctccaactgtgcgtcagcgctcgctagtagtacgagccccgacgccatgacttgggcccaacattccattggaaatccatgacccaatcgccgacgacgagtcggacccttacgacgactgatatatctacgttggtggaaggctgacgatggtgatgaaaaaacccccctaaattgaagccacgccccttccgcagccagcacccgagcaagatgactggctaacttgccgacttggctctggccaagaaaggcaaaacgccaacgcgaccaatatcgcattcgcgacataccgaccaggtcacgaccagtcaaagggtatttggcttaccaccgtttatcgcatgtcgtgatgcatacgtccgacaaagaaccggacaatggatgaccgacttgtcatcaaccaaatgcatcggacactattcaactatcggaccctataagatgaacggatcgaagagctacgcccgaaggacggacgacacccgactcgatgaacatgcccgactcaggtctgggcaacaggcgctcgacttaaactctcgactgtcgggtcatacgacagtcgggaggtcgatctaaaattggagctcgctctgtctttaacatggcgtgcgctaccgactgtcctggctagctatctgggatctcaccgaacatcctagctagtacgtcgggcctacgacttatacgttcgaaggcgtttcggcgaaacatacatttcaagactcatttcagaaaatgtaaagtaagaaagaaagttaaataaatttttttcaattccattcaagtatgaaccaaatttacaaaattgggccgaagcccgactacaaatacatcaaacaaaaacaaaaacaaaaataaaggatgctctgactactcgtcggagtcagcatcttcaatcgggagaagtttgggggcgatcggtgcggccgctcgagccggagtagcttcggggttcggagctgcctcgccttcggtgacctgctccgggatggcttcctccacggcagtatgatctcccgacgatgggtcggccaactctcctgcgtcttggccctccgaccctgggagaacaatgctgctgagatcgagctccgggtacaggctctggatcatttttcgagcatcctcgtaccccactcggtatgaaaggaaaccgctctccaagagttcctcccgatattcgttggagccgtggaagtcctccatggcccgacctatagcctctctcgccgactctgcctctgccctcgctatatctgcatcggcttgagcgaaggataaattttttttggccttgatgagattttccaaacttacccggagctgctcgcgttcggctttgagttcgccgacgtagtcatcccgctcgcggcgtagccagcgaacagtgcaggacttctgtttggcttccccgcaagccgactgcagctcggcccccgaggcggccagggcaccagtaaggcgggagatctcctcgaaaagatggaagatctcctcttcgagtcgggcctcacggtcgaccgactatttcagctgatcgaccattattgccttctcgaccttgacagccatggccttatctttccaggccacccagagatcatcgaacctccgatatccagcctccagctcggatatgttgtaaatcagctgcaaacaacagaccgaccgtcagaagaccgaactgataggaagtgacaacgaaaatgaaaagtgaaggagagagagacttacccagatcatggtcgggtagaaggaggaaagcatgtcggatatccgctgattcttcatgatctcgtggtcggtcggaaggataatcgcctggcataacctcctggccaaatcatggttggccaaaaccgacgcaccttcggaaagctgggcgtcggacgacgcaccgcggccgaccgaccttctatcgtcgcctggcgccatcggggccttcccttgttcggacacccaggccctgacatcagaaagagaggggaggttcgagcccgactgggtccctcccgaggctgcgacggtcgccgatgcagatcgatcgggctcgcgtgtctctgcccgaacctcgtcagccggctgtgcggccggcacatcttcggccacttcctcgaccgcctgtccctcggatggggcatcttcggccgcttccttggccgcctgtccctcggatggggctgctccctcgaccgcccgttcctcggacggggcttcagtgggcactgtcggcactgacagtgcgatgatcggctcacggtccgatgctcgttcggagccgggctgcgcccccaccgctgcaagctcgctcggcggcgctacctgaggtcgcgatggttcggctccgtgtgccggcctctttcacgccgcatgttgccgaacgtcggcttccgtcagcctcaccctcggcggcatgcctgcaatttcaatagaggatcagcaccagccaaaaaaaaagagagagagaaaaagaaaaacagacctagatgaggaaccgagctcagaccgacgtcatatagagcttgctcggtgacaagctccctctgctttggcaccgagatatccttcagacggtgaaaatccactcggtccccgtcctccacccgactattctcattcggctgagttcggaggtccccccaacgggaaggaaaccccaaggaagtggagaaaaagcaaagaaaaattggttcttccatccatagattgatgatggaagatcggtgatgaaggaaagacccttccgagggttgaaaaaccaccaccctcggactttagggtggggtcggagaacaaaaaatactcggaagagcgaaatacgaggattggtcggcaaaagctgacacaacaaaataaaactgactatcagccggactgagttcggcgccagttgcgtcggacaaagtctgtaatagtctgtatgttccggatgaactccgaaatcaaaaagcgaagaccggcctggaggtcctcgacgtagaaagccacctggcccggaggcggattgttaacccgaccatcggctccaggggtgaatagctgaaactgctctgggatgcagtactgctccctgagccgatcgatgttcggtcccgaaagtgaagaaacctccacctctggggtcgaccgagaacctcgaaaactttctaaggagggaggcggggacaactacctgagacaaggggggaccgctcgaccagagtttcgacaacagggctacgaaaagtggagtttggatgtaggtggccctatatatatagtgcccctcgacgaccgagatgagagcacgcccaatgagggtctcccagatcgtgacacgtggcggcatctgggccttccctcgatccgacgattcgacgtacctgccacagatcaggccacgtcgcctccatccgcctgaatgggttcggcccaatggccccctgccacgtggtgaaaaaattgcggcagtttgcgttcccgaggagacggcggaaacggtggtttctgttcccgatgagacatctgacaccgatggggatgcctgacacccataagacgtctggcgccggaccgatcattggtacgatcgccagagtcagagtacgatacgatggatatccactcctttcgcccgaagccgtcgcccacgcgaagatgctggccagcacgacatccgactcaggagtggaggggggcaactgttgggatatactgaccgacctttttcacgccgactcaccctcgggcctgtccgaccgacgtccgactccaccgaccgcaccaaccaacgactgtcgatactgtccgaccgaaggtatgtcgatcgggcggacccattctgttcccgactagccgaacggcggagcccgactctaccgactcactgtcaggctggggtggtggccgatgtccgattcccgcaatgcgccagaccagccgacggtgtccctgggtcttcacccgacgtcccgcaaccaaatgccgacgtatggtcggtcggctcccccaaacgccgtacgactgctgagggccgccgtcctgacaaaggcgtgcggcatagccgctctggggcattgtcctgtcaaggacatagattaatctcaacgatttgacagtccacagcgacttgacagtccgcgacgaatctgacagcctccgacgatttgacaactcccccagttgtctgcgccattaatgacggcaccacgtcgcattctactataaaacggaaaaggcaacagtgctgcgaggagattctttcgaagctcctggactcactctctctctcgctgagtttccctgattcttttctattgttgtctagtctcctctctgacttgaccgtcggaggatccccaccggaggcacctcccgtcagtgcggacttctcttgcagatgttcattcccggcgaccagacgacgagaagattgaccgcaacaaaaactaaaagaatatgctatgtcaaataatgcatatgctacttacgatccaaaatctcagttgcattgccatccaaagaccgtcatgctgaccagtaacttcaaccactggcttcttgcctattggcagcggattttaccaactattttttgtggcatttgaatttttactatttaaagtacaaacactgagtttccctttaaaagctagcttcaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttgagtatagatgcaataaaagaatccattcgtagttataagttgaatccaagactgtttaaattgtcaggccggaaaaggaaggccatagaactggtttcttgttcatttatggttgatcaaattattttccatcttttccccagaatcgtgatgcattctggaattcaatcacccatttaccttcatagtttattctttggccactatataaccaatgacaagaatttgagaatgtctgttggctacttactgtgtcttttcttcatagccttctgtctccgcaagcaaatgcaaacaaagcatgctagcatgagtgtgactatcacaagggagaaaatgataatgcgagttcttgctgcattcttttcatgtcctgcaccaagtgaaatttcgaagtatagctgtgcttttggttatatcatttgagtatttggttaagcaatattaaaggctataattaaaaaacacaagtatagcaagtctactttcctcaattttgtaaaatagattgcatgagtcagatgacataaataatatgattgaatcatggataatatgtttgtcctccacacaaatgtgcttgtgagtgcatataaaaaatactttatagtttgtatctattcttcagctttaagatggataatcataagagtttcttattttgtctaacagaacctctttccatggacaggaggttttttggaacctaaattgcaggttttgctagctacttgctgattttctcttggtattcacattgtctgttggaactttcactctctctgcaggaatgactgggttcctcccattgagagcattgacaggagactcacagctggaaagataaactcctctctttcagaggcaggcttatgtttgatgaatattatcctttcttctttcccaacattatctctgcctcctttgattcaagctgggttatcaagagaattgactccatgaagcattatttcttttggaaaggctgagaataggtttggtggagatcatgtctagcaaaatggagtttggtttatggggataaaatgaaaagtgtgttttttttggtttgaagaacttgagaaatatgaatctggctttcctcagtaattggtgttcactttgttttgaaggtttgggaaaagcaaggagtagaaaacatagatcaattattattctaggagaagtccttgttcaggggaatggtgcttgcctttgcttgcctcatttttctggaaagaccctgaagatggagaacttttccagatatgagaatattttctctatgtgttgataaagaagttttggcttgacttttggttagataagatcgctccaaaagacttatttcctaatctattttggatctatgaggatggcaagggactgaaagttgctcaggtgagagagaagagtgggctcttagaattaggcattttatttagaaatcattagttaagttcttaaatttacaaatcatcctattggaagttcaagcagcaacttctagggatggtcagagatgaagatggaaatccaatataagataatttcagcttttaaaaatataagataatattgtgcaagacatatataatgattgtaagataagttgaacatgcatcgctctgaacctgccttgtttgttctgttgaacttcctttcacgcacattctacaagctgtaaaattcatttcaaaccaacatgcttgtatcgcaaggaagttaatgatcgcactatgcaaccttcagttgcctcttgttttatgaaaacacagtttcttcatcacttaatgttagggcagaatccaatggcgagatagcctatattgatttcacaataactattggatctcattctgatcattatagatgatgctactcttatatgcccaatttttaccctaaaattttcttttcttaggttaagcaccttaaactactttccatgacaacttaaggcaactgattcaaattgagttatcacataaactgcaaacacatcatgcccaggaatcacagtctccagtggctcctaagttgtaaccgaatcaaattgagttatcaccttaaacggagttgttggtgaagacatacattgtataagggcatcttgttgtgcattacaaatgtttgtggcacctgtggaaattgaagccaatggtattgtagaagggattaggtgtgaagcagaactacagttcctaaagggattgtgccatttaagaggaatcagtgagtaaactttgcatggtccaaggttagcaatcagaaagcgatactatgcaacgttttttataatgcaattattgcagtgtgaagtatctttgatcaaacaataatatactggtgctagctggcaaacctgtaaatactttaaagaaaagttcgctactttggctggtttgtagaatcaacacttgtatattacagcacctgctctgttgcatatataatgctgtattcatttcgactacaggccaataaggaaaagctgatctttactgtttctttaaatcacccatcacttcatatgttattcacgatcaaccaagaaactatgcgtatatttctagattaatgtttaatatcaaaggagaattctgtcagtttcaatacacgcatcctagactcttatctacttctcaactaaattacgtagaaacatacgcttagccaaaaagacagagaaaatgtagccataaaactcaaattgatagaatattagtaaacaggttagaaataattgggtatcgaacggacttggaaggacttgtatattccctatcatctcaccagtgagaaagcgactaccaatggtcacaatgttactccccttaccttgttccttaggtgggttgataattggaggcactaccggggccggcactgcggcattctcctgcggctgctcaagtcttaccgtcgatggcccgtcgaagaacttggatgtcccatacctaaaattgcagctcgctgcgagcaccactccttcctgcctcccctctagcggtctcggctcaaggatgctttggaggcactgctggcaccggcttcgcgacaggtcctgtgtgcactgcaccaaccaatatatctcaggaaaaggagtcttggtagaattcatcatctccccggtggcgaacaaccgcgtcgagttgtagacggcccaatcggtgatcgcgctcataagctcgtccacaagcttgtcgaaccggctgcggtcggtcacgttgttgaggtcccactcgatccacgactgcgatgtgtcgacggtggagaagaagcgctggttggagtagcggaggaggcagtcgttgtagaagatggtggcgcccttgtcgtacgggcagagctggggggcgtcttggattgcgtcgctgaggcaggagcggcagacggaggcgttggtgtcgccgcggcacatggcgaggccgtagattttgttggggatctggccgacggtggcgttgaggaagccgccggagagagaagtgttggaggcggaggttgaggttggactcataggtgctgttgactgtgtagctgccggtagtgccacaattttggaagggttggccggcagtgggaggggaaaggaatatgaggaagagaaggcataggaagaaagggaaggaaacatggcgaaatgataccatggacgatgcttgcagcgaaaacacaatggctctggacacggcggaatagagatgttacgtgtgggtatggaaactgggtgcgaactttaggtcaacaatataatcagtagggaaccggctcatttcaacaaaagcttggcttagaggatatctaagttgaccacgaggatacgaggatcagggcaagcccctacttgtttatgatccctcacttatctgtataattttcttaggtagcatattacgtgacgccatccaaaatgtatctgactctaagcatcctctaatagacttactcaatggacaggccctgttgggttcaggtcagactcaacccaaggtatcatgtcatttaattagacccaaatctagtctgacctgtccttcagacctatttttcagatctaaactcactactcatcaaattttaaatttctgatctaagctttttgattgtattcttctttcttttttttctggataattcgatgaggatagagccagtggaagaggacataggaatgatacaattggttttgcccgtggcagcaacgatgagtatgaactgggtttccatctcattgtacacaagtggctcacgctatttttccatccattggtttctaatagtgaccattaaaatactataacaacagaataaattatctcacttataagcatgtctttaatatagataaactagttttttttaaatatattatgatgttcatgtggaaataactgaacatgagatatttgtgcgccttattaatgtgtcaaaatatccgttcttaaggatgacaaataataagcaaataaacaatgaatgtcgtatggctctctatttattgaaaaattataccctacatatgatgtatcccctcaacagaatatcctgccaatccattttcaccacgtggctatcctgacgacctcagcttgaagagagagagagagagagagaagagtgctttccgctcccctctgccccatcgaaaaccttaaccctgtctgtgtaccaaagaaaataaaaaaaccgcatcctctgcctccgcaaagccacttccctctcttaccacaataaaaaaaaaaaagcgacttctctctccacccaattacaagcattgccaatcgacatctgtacgtggaacccactagcgtgaatcagatgggggagaaattattgcttggaccacgcctaagtagaccggtgcacatagcatgtatacgatggataatgtgtaatcgaaaattttatgatatacaaaggttaatatggtgtattatccattatgggatttggatgatctatttgaatatgatccagacaataatttttgaataaattataaaaatatcctctcaaatttaaatcattttcatttacaccccttatactttaaaaagtgtcaaactgattcttaaagttttgaaacgttccaacgagatcttttcatccatctccattaatgaaatcttattacataactatcacatgatattattattttataaaataataaaaatatctttatgttcgccttctccctcctccctcttccttcctctccaattgatctccttcttcgattaacctccacccattcctccaccgcctccccttcctcctcttcctcctcttcctccctcctctccgattgatcttctccaccacctcttcaagatgctgacttctctctcctggatctgttggatcttccccaactccattttagcacattagttgggatcaggaatgaagggcctcgggattgcagccatcaggctcgattgatcctccatatgcgcttatcttggtagcccgtttgtcggtccctaattcgccactgctaacatcgccattagcaacccgcttgccagccctcatttaaaaaaaaagcactttgtaggcctaggacgtctatgtttaatcttgatgacaatagattaccttaattcttttcactgttagttctcaggccaagtatatgagtggaagttgaatttgctgctccttcaaaccatctatgttttataggtttattcaaatcagccaagctgtgatctgacaaactattttatgtccatgaatcttgtgccttagtgtcctttttgcatttaagaccctcaccagtgcctaaagtaagctttacatcattctgaggatcagagccgcaagttctactaggtggaactgtaactctagatgatgaaacaaaacttttctttcctgatctttcaaaatcttcactatcaatatatacatctactagaagttgtagatcaaacattctcctaagaaacttctgaaatttagagtcaaaaaatttaacatcttttagagagtccccattttttattgaaatagcatcaaactacacattactttccttcagaaagtttaaggacatcctaatgccatcagcgcttgcaaaagttgatctgtcataactgttatttactataggcaggtgagacatctgccacatttttttggtaccttcacatggcatttgagatgaaaaaaaaattgactgagatgtattagatggtacagaatatctgtgtagccccttcactcatccgtcaggtccctctgtattctataaagacggtgcagttcatgatagacctaaattgcagaataagactgcaatttcagtgatgacaaacataatattaaacaactaattcatatattatgaagaagataagaagagaaactaaggtgtctatgaagaaatggactgccccaactgccatgcattgttgcaaaaggaaaacaggagagagaagtcgaaaagaggtttcatcatcgcctcgataggaaagatattgcaagataaagagaagaatgcattcaaaatagagaggtcttaaataacagccatggcatatcgtggaagagggcagctcttggtagcaccagagcaccgaccaactcttcctggttcctccatcaagtctcatagctgagtagaatattgggctgaaaacacagttgtccaatgaatcgagcagcttgagcgtgtctctagattcaatttgagacaagcacgaatcaagttcggttcaaagcatgaatcaagtagaagactcgtatgcaccaaaaagaggatttgatgccatttggatggtagtgacaattctgagaaaaataaagacggcaaatatcattgtgacaaaaccccacaaaaacattataaactcctagagcaaaaaaaacttcaacagaagaattctgatttgcaagatttcaaaacacaaatatcataaaaagtattattttaggaataaagaacagaatgatgaataagttacctatctcagaacataaaaaggacacaaacaagtggcaatagactcagattcacctttgtaccatcattccacttctgaattatttatctacaaatggcagtagaggttgttaggggagtctcacaatagtcacaaaagaaaaatactggaggaatctacaaaagcttcatcatcaatgcctccagagaaagatagagcaagacatatataaagagaggtatgggaattaagagctgagttcagacaatctctagttcatgactggggagacaaccatcactatggaaggcactttggcttgcccacaagatttttccaagacatcaatggccgtcccactctttgccaccatcgtcgcaaagccgcccatcatgaagtccatagctatcttcctcgatggcctcaccaccaccttccctgccgcttcagtggtccggccgaagccaccatcctcctatcgtcctcttccctctagagaggagaaaatttcaatctccatgtagaggagcatttttgttcattgtaatgacaagcggatgccgtcagaggttaagtgatcatgggggcttctttgaaatgtttcgaaattttagggatccatttgatattttttaaaatactgagtgtaagtaaaaatggcctaaatttaaagggatgtttttataatttattctaatttctttgacatggtgtaccactactattctctggccatcgatgaggtgttcacaataaaatccattgacaagaccctcctctctgaccctcttaccacaatctcatcctccaagaggccaggatccactagcttgcctttgtgaggagctctcatgccatttgtatccatgccgcttatgagaatgccgactccctccacctcctcaacctctactcagggctcgagctgttcgcctgcatctggatgtgccccactccccgaatgcaaggtcgccatggtgatgctcttgctgatgaagacaatagccgcatgccatggatggaggataatccaccaagatgtaaagaggggtttttcatcattgagcgctcccttttttctctcatcagaatggccacagggtgaaaacaaattagcctagtgtatcgctgaggtggtccaaatgtagggtataatttctcttatttatcaaaaaaaactataattttgctttttggtgaagctaatcagcatcatgccatggcaactcatcagcattatgttggttttggagaaaaattgaaaacttaaaattttctctatctttttccaaccaaacctctagttttcacaaagtttagtcccatattagaaagagaaaaaataggaaaggagtttattttgaagactcttctcttaggcctttgaacatgcacgtgcagcccagcctggccctgctcgcacatgatcgcgctgtgcctacgtttgcggtgtggtggggcctatattttatttctccaatctttatttttcctgttttaactttttcgaacattgtattttgcctgttgaaatttgttaatttgtttctgtccgtttatgatcggttaagttgtttccttccatttcgtgatttgttaagttgtttccacccattgtgagtggatggttacaagattaacattggattagccagtctgtaggcctataaaatggccctatggtggagggatttagtagaaaaaaatacttgctccttctcttctaatctcattcatcttctctgccattattttttcttaaaagtctttcttgttcatttgatcgttgatctgctagtcgaagctctgtcatcttctctatagtcgtgtccacaggggagatcttcggttgtatcttgagatagatttttcgagtctgatccgcacgaagatcaaaaatcaccttaggacagtgcactacccacttccaatctgtaagctttagattgatttagtattaatcttatatttattttatactaatttaatgttaatatttgtttgttagtttaattagattgcaatcggctcttgcagaaaacaagattcctatcattctaaggcgaatcccgttccgattgtgatttatagctagaatctatcaaatttcttagcataataattattttgtataatcaattttgttagagatagtgtaatatttatgtcatcttaactttctcatcttggtataataagtttgagttaatgatagtatttatttttcctgctaatggcctattaaaaatttgataattcataaaaaaacttaaattgctatttaccagttctattctacatttaaatttctatttatcaattttgttctatattttaatttctatttatcagttctattctaatttttgtttatcagtgttgttccatattaaaatttatttaaatttctgtttatcagttctatttcatattaaatttatttcttactattagtagaaaaataataagtccttacagataaatcggtgatatggaatcagtaaaatatttcgatatatattttttgcagctcttttctcttatagtcttgtttcttagtcttcttttgagattttttttctatgggttctgaagattcttctagtcttaaacctaataggttcaatggaaaagattttcttaagtggcaagaataattaaaagcctgattgatatctttagatttgctttttgctttagaaaaatcactaccatttgaatcatcctcttataaagattctaaatcatttgaagagatagattattactatacgtttagaattctaagctgcctatctgatgaactatatgaaatttatagaaaatataagatctctaaagatctttggcaagctttagaagaaacctatatccgagtgagttaatgagggggctataaggttcatcatttttgactttcgtaattttaaaatggtagacaatatgcctatcaatgatcaaattcatcaatttcagaatctagtccaagagatttatagagggagatctacttttgatgaaaactatcaggtatcatgcttgatagacaagcttccaccttcttggtctcaatttacccatgactttagaagatcgctatcttccctcaaccttaggtctgtttttcaatctattaggataaaagatcaatttagaattagagagattcagaaaaattaagaaaattattttcaaactaaggttaatcaactgaatctcaaaacccaaatccaaatcctataggttaaacttatagaggtcacagcccaaatttcaaagctaaagaaaaaaaatttaaaggaaagagtaaggctaggtttaaaatcaaaagctaggtctaacaatcaaatccaaaaatcaaggaacaagataatgagaggtctgctttgtcagtagtcgggacacctatcttgcatccaaatgttgctactagaaaaaggagaaaattttctataaaaaaaataataaaaaccaaaatcaaactaaactttagatcaacatgatagaagaagaaccatcttcttttaggtcagtctctttttctccatctatcaatttaacttactcagatttagagtggtggttagataccggagccaacatccatgtttgttcagataggtcttattttttatcatatcaaaaatcaaggggaggaagtgtaaccataagtgatgggatagctgtcaaagtttttggaagtggaacagttaacttgaagtttacttcaaaaaagactttagtttttcgaaatgtgcagcttatatccgtcataagaagaaatttgttaagtggttctcttcttgttcaattagatttcaagattgttttaaagtctaataaaattgtaatttctaaagaaaaagtctatgttggaaaaggctttgtgtccgaagggttgttcaagttaaatatattctctccttccaaaattaatgaaagttcagttagttcttcttcatctgttatgctaaattctgaatcttgtagaacatgggatggaagattaagacatatcaatcttagatcaatcaaaagaatgtcttatcttaacttgatttcaaaatttaattttgatcaaaattcaaaatgtgaaggttgtgttcagaccaaacaatctagaaaatctttcaagcctgtagcttttagagatacttaaattctcgaattaattcatagtaatgtctataattctaatagaggaccaatccatagaagtaatcgttattttgtaacttttattgatgacttctccaaattttgctatacctatcttttaaaaaccaaagatcaagtcttaaacaagtttaaggtttataaagcagaagctgaaaatcagcttgaaaaaagaattaaaatcttaaagtttgatcgaggaggtgaatatacttcaaacaaattaatcctattctgtgaagaaaataagataattcatgaagtcactgttccttattcttctcaatcgaatgacgtggctgagtgaaagaatcgaatcttattagacatagtcaataccatgattataaattctagtatatctcaaaacttatggagagagctcttctattagccagctatatcctaaatagagttcttcctaaagatagagaaaagacatcctttgaattttggaaaggatattcttttagacttagttactttcgagtttggaggtgtttggctaaagttgaaatttttgaatcaaagagagttaagataggatttaaaactgtggatgctatttttgttggctactctttagatagtaatacctataaattttctatttttaattttgaaataccttcaatatcaaacaatatcattattgaatctaaagatgctacctttttcaaaaatatatattttttttaaattcagatttctagatcaaccaccgatcaaccattctctttagatttacccccatcatcatcatttattcctattttagtagaattaacttctgaacctaagcttaggagaagtaaaagaattagggttgaaaaatactttagtgatggcttctttatcttttcgatagaagataccccgatcatgaactctcctgatgctctattctggaaggaggcaaaaaataatgaaatcgaatctattattagaaacaacatttggattttcattgatttattttctgagaacaaatctttagggtgcaagtggatctcaaaaaaagattgaggattgatggtacaattgaaaaatacaaggtaagacttattgctcaagattttggataaaaaatcggtattggcttctttgatacctattctcctatagctcatattactactatccgagtcctacttgtcttatcttctatttataaacttgttgttcatcaaatggatgttaagactatctttctgtatgcagatcttgaagaagagatttacatgcatcgacctgaggattttttttgtgttaggccaggagcataaagtttgtaaacttgttcgattcctcaatggattaaagcaagttcctaagcaatggcatgaaaagtttgatgaaataatttttttctatggatttcaaatcaatgaatcagataattatctttattataaataatttgatgatcgattcattcttctttgtctctatgttgatgatattttgattcttgcttatgatattgacttaatcaataatattaagaactttttatcacatcattttgatatgaatgatttaggtgaagctgatataattcttgatataaaaatcattcatacttctgatccaatttatttatcccaatctcactatactcaaatagttattaataaatttggatattctaattctacttatgtatttactccttatgatccttccatccacctcttaaagaatgtatgaaaatctgtagatcaagaaaaatatgctcaaattattggttcattattatatctatctaatcgaactagaactgcttctagactttgaagatatactagtaatcctagtctagtttattgaactgctttagagagagcatttcgatatcttaaaggtactataaattattctttacattttgtaggttatccagatatacttgaaggttgtagtgattcaaattagatttctaatatattagatgttaaatcaacttctagctatatgttttttctaggaaaaagtgttgtttcttgataatcttccaaacaaacaattttagctagaagtactatgaaaactaaagttgttgcccttgattctatctattctgaagctgaatggttaaaaaaacttctatctgagattccttccgtatcttctcctattcctctaatattaatttattatgattcaagagctgcaatagtttttgtaaaaagaaacttataaatgctaaagtaaatagatatattaaactaaaataaaagtccgtaaaagaaaagaaaaacttcaaataatttctttgaatcatgctgcaactaaccttaatttagtagattatcttacaaaagacttaaataggactaagatcctagagtcatcgaaagggatggggcttagcctataaaggaccttccagttatgggaatccaacctctgtgattagagatcccttgaaggaggttcaatgtggtaataacaagctgattggttggtcaaggagcacatatgatttatttgatataggagtcataaattttagtccatccctatcactataaaaaattaaggtattaacgatagccattagcgatggcatttttatcatcgctaatatgcctataagcggcagcattactgatagcaacaatttcatcgctaataataatttcaccgatcattattagagatgatattttcaccgtcactaatattagttataccgatggtgtaaaaggtattagagacagcatcgccgtcgctaataatcaatagcgatgtcattattagagaaggcattcaccatcgtaaattttttttatttgttaaaattattagagacggcgaaaagaatattagcgatggtaattgccatctctaataattattagtgacagcactcgtcgttccaaaaaataaaaaaaattatttattaaaattattagcgacgatgaaatgagtattagcgatggtaattaccatctctaataatcattagctatgcactattagtgactgtattcgccatcgcaaaattttttttttttattaaaattattagcgacggtaggaagagtattagcgacggcagttgctgtcactaatattcaatgcagaatatattttttttattttttaaatattatataattttaaaatttaaagtccatcttcaccattcattatctaaataattatcgttagagtatcgtcacaaaaatttatctcgatccgataatcttaaccatgccgatcaataaaatttgattttaataatcgcgaacaagcgcatgatgatccacacccattaaaaaatcacaattattatctttcccagttcctgatccaatcatattgcttgactacagcccacatgggaaagtttatggaatcatccaatctttgtaagaaaattgtgatcatgtagtacaggcgacgatcaatacctgatcatgcacatagttgcacggatggccattcaaattaggacgaaactggtgaattcacttctacacgtagccgcctgctttagatagctgcaaaagtgctccatgcacttgtttgaggaggtcgagtggagtaatcatatactaagacttggtcatgggaaatttctattaagggttacttccctgcttcagagattccccagaaactagaatggatactcactgcctaagaatttccctaacattctttaaaatttatttccttgtatccacagctgcacctgctcccagttttggcaactaaggtttaaagcatgtcatacctagtgatatggtgtcgaaggatgagcctctcatggactcatcgaatactgaacaaaatcttaaacttgcgaaggcgatgtgcttgctttctattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaactattcacgctctaaggttggtaatcagcctgtgatcctaaggaattgttaatttggtgtaattatgatagtgtgaactacctttgaccaaacaattatatactggtgctagctggcaaaacctttgtggaaataacctttttatattacagcactaggcatcagtgcccactctgttgcttacacaatattgcttttgttttctaccgcaggcaaataaggaaaggctgatctttgctgttattttagatcacccaccacttatattttttcacgatcaaccaagaatctgtgtacatttgtagactaacgtttaagaccaaaggagaactctgttaagtttcagtagacagatcctagattcttatatacctctcaactaaattacgtagaaacgtacgtttagcacaaaaaacaaaaagaaaatgaagccataaaactcaaaactgataggatattagcaaacagattagaaatgactggatctcaagcagagtagaaaggactcatctattccctattacgtcaccgtcgataaaccgaagctattgcaactagttcgctagtaccggtcggaaaaatcttaccgctcttaccttcttcattaggagggttgataagtggaggcactaacgtggcaggcgccggcgccggtgagttctccagcggctcctcaagtcttagcgtcgctgccccgtcgaagaacttgtatatctcgtacctaaaattgcagctcgctgcgattaccctccctccctgcttcccctctagcagtgtcggtctcggctgaaggatactttggaggcactgctggcactggctgggcgacaggtcctgtgtgcactgcaccagcccatatatctcaggaaaaggagccttggtagagttcaccatctgcccggtggcgaacctcctcgtcgagttggacacggcccaatcggtgattttgctcataagctcgtccacaatcttgtcgaaccggctgcggtcggtcacgttgtaggcgttccacatgaacacccgcatcgaggtatcgatggtcgagaagaaacgctggttggagtagcggaggaggcagtcgtcgtactcgacggtggcgcctttgttgtacgagcagagctggggggcgtcttggattgcgtcgctgaggcaggagcggcagacggaggcgttggcgtcgccgcggcacatggcgaggccgtggatttggttggggatttggccgacggtggcgttgaggaagccaccggagagagaagtgttggaggcgaggtaagggaggaggaggttcatgaggttggactcataggtgctgttggcggtgtagttgtcggtggtgccacactgtgtgtagaggggatcgccggcagtgggaggggaaaggaatatgaggaagagaaggcataggaagaaagggaaggaaacatggcgaaatgataccatggacgatggttgcatgtgaacaccgtgtctctgaagtctgaacacggcagaacagagatgttaagtatgtctggctatggaaacagggcgcgacctagagggaaccgcgaggcgacgcactgggaggaagctggaaatgccatgggaaagattgggagctgctgtggtcgacttggtcaaagcgaaattgtggttttattgtgagatttgccacgcccacggggacaaattatggtgaatttggtttcgtccagtggcatggctatatggctttgatcaataggtgttaagaccagatacaattgtcttgccaaattatatttatatctcggcgttcatcattttgcctaatcaaaccagaaaaaatccattaggaccatggaatgcccaccgtatgatcgacgggtgttctctggtttgcataatttgcaacctaaatctcacgtttgttgcggtcaagttccacgctaaataaataaaaaaatataaaagcgcaaacttgttggaagaaaatgaaaggactgaagactttagacgtgcgcaagggctcttagtcaacgtaggagggccctcgaaaactagcaaggaacaactggataccatcaaaattatttttttgattgtaagggaggtgggggcgaccccgcttttattggataggagaaggaagctgcagagaaaaaaaattctgcctagagcttgggcaggaagcagttatttacatcttgtacttatttttgtcggcgttaacaaacaaaaattttccaattacatgtttgttagctttaattgattgaaggcaggtttcataagatagatagtactaaagagcataaactttgatttttcgctggccaattaattgaatggttcattttctaaacggttaagtagcaaggggatatgcccaacatctattgtgattggtgcttcgtgttgcagtttgtttgattcccttaattagtattccgtgctacatctggaacttacgtggctaggagtttgtgtgggtactatgctaaaaaaatacctaagacatggataacatagttgctggtcacaaaatttgctgggtaaatagtaagttttaaccgtcagacagccactgctttgtgttcatgcattcgtgctaggttggacccaagattgggtgcagtgttccagatgagcttttgtttgccttgggtatacggtaggaattttaaaagtcatgggttggttgttaactgattaaatgtgaaagctgaaagatgtaacaaagtaaagtatttagagatcacatattgctaaagacatgaaacctagtcacaaggttttctttttcctttttttttttttgtactgaaaagggaagcaagatgccacctgattttagtgcagggaaagaaatttacaagagcttagtcgaaaacccagcaagagcagagagaaagataggagaaaacaagacagagatcaagaaaatatttggttaagctgagcgtagcactgtttcagcagcatcctgatctcccgagcagtttcagcaatgttcgggaacagaaaagcatatgttcagtagcgcttcagtcaagtttcaactgagttccagccagtcacaaggattgaaaactaaaagaatatgctttgtccaataatgcacatgctacttacaatccaaaatctcagttgcattgccatccaaaaccgtcacactggccgataacttcaaccaatggcttattgcctattggcagctgattttgccatctttggtggcatttgagtttttactataaataaagaacaagcaacgagtctcccttgaaaacctagctatcaaagtaacattttcatgatttgtcttgtggcttattgtttgtacaaaagagtcaaagcagtcgaaactcaacagctaggatgaatgtatttcatagaattatatatatatatatatatgagcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaaaatttccaagcttgctttgttgatccccaagcctggattccctttccatcagtcctagccttatttctctgtacatgaaaaagaaaacaaaaagaatatgagctacaccagctcagaagtagacttccgcttccttaccggatcaagcataagttttctatgataatgcatcatttagtaaataacaattattgtaaaaaaataaatatttcatagagcatataataaaataagttttaagctcatcatgcatgaataaattatgtatattttataattatgaatcgtaaatcattttcatcatatattcatgtcatgtttcaaaatattgctcacagacattcgtgctaaggtcactattatacccgtgacagggccatgtttcttaatcgacagagttcttaattcatgtgccaactttatacccgctggtagggccatgtttcgtgtgaatgctagctccggatgtcgaccttcccgaagagattcattcatagctatctgagagcctttgaaatcattttatctttttcttaaaacatacatatacataaatgaaaaaataataaaattcatgcttcataatcatgctgtttttataagacatattcatgaaatcaatgcacataataaaacatactttttcatatcacatatgccgatccttgttttataaaaaaattatgattttatcaatgacaattctttacataaaagcatgatcatttaaaaaaaataaataaggagcataaaatccacttacctcgatcgtcctggaccttttaatcttccttaaaagaatcggacagtcttatttaaaatattaaatcatcaataaattttattttatatatttaataaaattatataatataaagaaatgaccgatttgatgatcagtacaataaatctctcccttcggttctaaaccgatttaaggtcataggtccctaggagtggagaagatagcctaataggggattcataggactttttggagagagaattttttttagagagagaaagtagagagagaatgaattcaattctagagagagaaagactttagtgagggatgagagaaacttccttttatgtgtattattattattattattatttttattatatatatatatttttcttttcttttctattttcttcttttcttttctttttattattattattattattattattattattattatatgattatatatttttcttttcttttcttttccttcttctttttctttttcttttctttttctttttcttttctttttcgttttctttttcttttccttttctttttcttttttctttttcccccgtggccttctttggccggaacaggggacccagaggtccctgttccttaaaccggccgttcaaggccgcaccttgcccgacggtggccgacggcaagggacaactccccccgaattcggaaggccatagccggcggtcggtggtggccgtcagtgccggaaaatcagagaaaagaaccggtgagaacaggggttttctttttcaacaaaatttgacgacacccgtcgccgacaatcgtacccacaggcacgagaaagaagggagagaagagaggaagaggaaggaggccttaccacagcctccgatgacccccactagtgcgaaatcgcggcgagcacaggtcgaggggccgcggctttaatcgaaaaaatcgaagaaaaactccggcgatcgtcggtgactgttggatctacacttagaggagaggaggggggttcttatagagctcgtcctagggtcttttaatagccctaggactccaattcttgatcggaatcgaggaagaggaagactccgatcgggagtcttcctccctgtttctgtattttttttttttactgggctttacagggcttagtgggtcgggttatcacattctacccctcttaaaaaaaaatttcgtcctcgaaatttaacataccttcatttacaaataagtatggatatctcgtcttcatatcgtcttcaagctcccaagtggcctctctctcttcatgattactccaatgaacctttatgtacggaatgatacgtcgtcttagaacttgctcttttcgatcaataattcggaggaaaaatttttcataggttagatcttcatgaacttgcaatggctcatactttatcacactgtttggatcaagtacaaactttttcagtagtgaaacattaaagacattgtgtattttggataaatctggtggtaaggctagttcataagtaacatctcctactcgatttagaatttcaaaaggtccaatatatcgtggcttctatcttctttggatcaactgagattccttccttagatattacatggctgaggaagacaacactatccaaccagaattcacacttgctaagcttggcaaagagcttcttttttctcaagatctgaaacacgatcctcaaatgtctctcatgttcctttatatttttagaatacaccaggatatcatcaataaaaacaacaacgaattgatccagatacagcttgaaaatcctgttcatcatatccataaaagcagccggtgcattggttagtccaaaaggcattactaaaaattcataatggccatacctggttctaaatgcagtcttagatacatcttcatctctaattcttagttgatgatagcctgatcgtaagtcaaatttggagaaaacttgagcaccctgaagttgatcaaataagtcatttattcgagaaagaggatatttattctttatggttatcttgtttaactctcgatagtcaatgcataaacgcatgctccaatcctcttgagacaaggtccattgtgattttttccacagtaggagcaggatgaagattctttcttcttatcagagttattatttctgaaatttttttactgatcctttagatttcctgttgatctcgatctcttcttatctcctctttctagatctgctcttttcaattcagactccactttcaaagctcgctccggtacgtccttgtagttattgaaaatatgagaagacagacgggatcgaattccatatcttagaccttgttcgaatctgttagttttactcctctcgaatttcataagctgggggcagaagcggcctaactcattaaatttgttagcatattctagcaccatcatatcatctttttgctttaaggctagaaactcattttcttttaccaatctcattgtccccgaaaagtactgatcataaaatatctctttgaattctttccaagtgagctgatcatcattgttcccataggcagcttttattgcagtccaccaaaactcgatattttcttttaacataggaacggctaatcggaccttcacattctcaggatattgcagggcatcaaatatcttttccatctctcgaatccatgtctctgcagccataggatcagatccaccctcaaatagaggtgggttgagccttctgaatctctcatagtacgactccatagataatgtcagtcgaggagcagtctgtgcctgatgctggataagctgagccaccacttgacatacaccagcaatatccgcctgtgtggccggtgcgtcaggagcccgctcaacaggttgattgtcagctcctcacgatgtcagtcttgctcctcttgctcctcttgtcctagcggccatatttgccaaggtctcgccctccctatcgctcattgcttcctattcaaatgccaacattattacgttattttataacagagttgcagtacagttaataattcaagtcagagtctaactatgcgtaacctaactactcactattagattttaagttctacccttgattaaacctattgctctgataccataaaatgtcacgccccaaatccgggatataacacggccatgctaccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaattcggaaggccatagccggcggtcggtggtggccgtcggtgccggaaaatcagagaaagaaaccggtgagaacaggggttttcttttccaacaaaatctggtgacatccgtcgccggcaatcgtgcccacaggcacgaaaaagaagggagagaagagaggaagaggaaggaggccttaccacagcctccggtgatccccaccggcgtgaaatcgcgacgagcacaggtcgaggggccgcggctttaatcgaaaaaatcgaagaaaaactccggtgatcgtcgatgactgttggatctacacttagaggagaggaggggggttcttatagagctcgtcctagggtcttttaatggccctaggactccgattcttgatcggaatcggggaagaggaagactccgatcgggagtcttcctccctgtttctgtgttttttttttactgggctttacagggcttagtgggccgcattatcacagtattaagacaaagcaagtattctgaagtactttttctatcatccaagaaaccagcccaatcactatctgtatagccaatcatagaattctttacttctttcacatgcctgatcccttggttctttgtgccttgcaaatacttcaaaactctttttgctgtagctagatgcaaattacttggatcactcatatatcttgaaatatagctcatcaaatgcattttcggccttgtactggtaaaataaatcaaggatccaacaagacttcgaaattcctttgcatcaactttctttgctccatcattccactgtaatttttcattcaaagccataggtgttggtgccattttgcacttgtctagttggaatcttttcaacatgtcttcaatatatttctcttgaaaaataaaaatttctcctttagattacttcacttgaattccaagaaatatttcatgagttccaaatctgtcatctcaaattctttcatcatgttgagcttgaattctttcaccatctttaaataagtgcccatataaatgagatcatcaacatataaataaacaacaagaaaatcttttgtaccttacttcttcacataaagtgagggcttacttggacttctttgaaacccattcttacagaagtatccatcaattgtacaattccatgctctaagtgcttatttcaacccgtagagggcctttctcaagcgatatactttgtcctccatgccttggacttcatagccagatggctacttaacatacacttcttcttcaagctctccacttaaaaatattgatttgacatcaaactgatacccatataatttcaattgagctgctagtgcaagaatgattcgaacagtctccattcttgcaatcgatgcaaaggtctcattgaaatcaattctgggttgttgtgaatatccctttgccgccaatattgctttgtacttttgaatagaaccatcttcattgaatttggtcttgtacacccatttcaaactagtcacatcctttccttttggcaagtccacgagctcccaagtcttgtttttctcaattgttgtaatttcatcatccattgcttttctccatacatctttcttggcagcttcttcaaaagattgaggttcacatccaaagaaggctacttcatatgattcataaatatttttcaaagaatacatcttccttggtggtgaatccgaattagttgttgcttgaacttgagaacttgaattaacacttgctgcccttgatagtcttgcatttggtaatcttgatggacttggacttggagaaggagcaggacttcaaacttgagttggagtttgaggtgcttgctgctcttgccttcttgttgactccaaagattcatacacaagtgctggttgaggagagttttcattccaatcctaagctgccatttcatcaaatataacatctcttgacacaaccagctttttagtcataggattgaacaatcgataaccctttgattcatcactatagccaataaaaattattttttctcttttttcatcaaacttgtctctatttggagtagaaatatgaatgtaagcaatgcagccaaatacttcaagtggttgacaaccggcttcttgttatgctaagcttcaaaaggagtttgattgcggactgccttggtcggagactgattgaggatgaagatagatgtgcgaatagcttcagcccaaaacttattacaaagacctttgccctttagcatgcttctagccatcttcttaatggtccaattttttctttcaactactccattttgctgtggagttcttcgaatagtgagttgcctttgaatgccttctttcttgcaatactccatgaatggagtgtagataaattcatctgtcagtccttaatgtcttgatttcatgaccactttgcttctccacaagagctttaaattgaagaaaaatagaaaatacttccgatttttcatgtaagaaatatagccacatcattctagtataatcatcaacaaagagaataaagtattttcgattaccaagagaagaagttctcgtaggaccacaaatatcagtgagcaccaattcaagaggagctttagctcttcaaaaagtcttaagaaatgaaagtctatgcatcttaccatatatgcatccttcacaaacttgatcatttctttcaatggagggaagcccaacaatcatgttcttttgcttgagcaagtgcagccctttgaaacttagatgaccatatctcaaatgccataactgagaataatcaagggtatccggcccctttgaaaggaaacttttctcccaatggtatagcaagcggaaacactctatttgaactcatttcaattgttgccaccagagagttagttttcttataaaaaattcttacttttcatcatcaaaagtgactgaataatctttttgcaagagctatccaatactcaagagattttgagtcaaattaagaacataaagaatatcattaatgaactttttgttacctccttttgtgtggcagcaatgatgccttttccttcaactttctaaatatttccatcaccaagttgaatgctggaaataaagttttgatctaacttcacaaacatcttctgatctccagtcatgtggctgctgcaaccactatccaaaaaccacacatttggtgtcccttgttgaacactcatgcaagagaacaattggtcaccttcttccttagtaaatttggcttcctctttcttggtcttgtccttgttccaacaatcccaataagagtgagtggcattcttgcacttcttgcacttgaatcggcaatcctttgtctcatgatttgtcctattgtaaatatgacaatgcatatgaaagtttcttgattgttactgtccatctcccttcttttcaaaacttttgctttcattcttgttgccttgccacttgcctttattttggaatgatccccatctatttccttgctggtatttgaagttcttctttgaaatattgactttagcttgaaaagcttggtcaaggggctgattagatgatctgtccaatctttgctcatacacttggagagaactcattagctcataaaaggaataggaagagagatctttagacttttctattgctgcaacaacatgatcaaattttattggaaggctcccaagaaccttttgaacaatttttctttcttcgatgacatcttcaagacttttaatttgatcaataatttcggaaactttagtaagaaattcttgcatgcgttcaccttttttcatcaatatatcatcaaagtctctctaagtaattgtagcttcaaggagatgactttctcatttccttgaaagtctttttttagaatatcccatacttccttagcctttttagcatcaaaaattcgaggaaagatagttttgcttaccccttattggatataccaaagtgcacttgcatctttcttgacattctccttgtattgcttttgttctcctccatctaattgattcgattttcaggtggctctggataggagtcctcaacaacctcccaaagcttttgagaaatgaataatatttgcatttagctactccaataatcacagtgctctccttcaaagatgggtacttgatttggagtgtatgaagacatagttggaacggagatggatgccatttgggataagagatgatgcttctagatgaaaagtaaatagaagcagaggttggaagtgaaagctctgataccaaaaattgtcgggatagctgaaagctttgtggtggtgattttattttattttttttgcaaggaactagaagtttatattgaattttcactcaagaatatgttggtgcatacataattcattaccatttttctctcatactttcttatccattctgcaatctctctattacaatttatatatgagatatttagtctagagaattctacatttaagagttctcctatttacaatgcattaaagagataacagagatggtacctgtgcctgacaatttacaatgccttgggaagtttggagtgacgatacttgtgcttgaccattcaacctcatcttctgggaaatagagagagctaacttgagcttgaccattcaacttagacttcactgttccacattgttccaaaattttcttcttaaatatcttcttaaaaattactaattaatctccaacaaaggaggcagtcgtcgaatacgatttcggcacttttattgtactggcagagttggggtgcggctgggattgcctcgctgaggcaggagcggcagacggaggcgtttctatcaccatggcacatggcgaggctgtagaattggttgcgtatctggccgatggcagcgttgaggaagccaccgaagagagaagtgttggaggcgagggaagcgaggaggaggttcatgaggttggactcataggtgttgttggcggtgtagttgtcaagggtgccacactccctggaaaggaaatcgttggtagtggtgggggaaaggaatatccagaagagaaagcataggaagaaagggaaggaaacacaatgaaaagatactattggtgtacgttatctgaccttatcatcatccgacaagtggtattagattattatttgagataaatattttctcaggttatattgatccatggccaacctgcctcttcaatattatctgctaatcgacttaatgcatgactgctattaagtgaaatactcacctcgatttttttccgatctcctttattttacttcagttatctgtcgacctgattgttacatcaaagacatgatgtccagtttagatagttactgatgtcagctataccacatcagtttgttaccgatatgtcaccatgtctacgactgttatacaacttagccataactgtctttcagttgtattccagctcatttattatgtggacagtcaccccacaatctctgcacagctgaccattctgttacagcaaccaaatggcctaatagatctctaacggcctaatagcttaacagatctctaacggttaatagatctctaacggtctaacaactttttcttaagacctaagcaagttttctctagataaaggaggacaaggtgctctctagagggtaagttaaatccgaatgaatagagacaaaattctgctaaattttttaaagaaaattagaatgttctctatttttttccactcaaactcttattttttattttttacttctttattttcatctggctaacttaagtatcggaaaattctaaatcagaaaacatcccacggtttttgaatttttttttttttttttatagattttgtctcacgattcacgttgatataattcttaactctccagctcgatttattgccaacttcatcttcggagccatagatgatggtcatgggaggaaggcggtggctctgggcacgacatataaataggtgtcaagtacgtctggccatgggaaagggttggaagcaagaggggaattatgaggtgacacgttgggaggaagctggaaaaccctttggaacgagaaacgactatggcagcagtgggggtcgacttagtcccaggaacgatagcatggcttcgatgcgttgttggtccagtctcaaaaagaaagtttcaattattttaacttttttatttttggaatgacacattgacgatattttaccaaattgtatcccttccttttttatattcttaaacgtcccgacccattgcgtcggccccattacatgactacgaaatttctaaattatggtcctagaaagcgcgttgaacagaatttcaagaacagcaaatttttaggcatcccgtgactcaagagaaaaaaataataataataaaataaaatgagctcaataaaaatcttcacacatgctcatcaatataataatttaaatttaaaattaataaataatcattactgatataaatgtgataacattagatttgatacaacagtccggtgtaaaacatatttttccagctcaacaatatatcacataatatcaaaatattttttcatgctaaataatatcaaataattaccttgatttgagattaacatgtatcaaatttgataatatttaggttcttaactaaaaactaacaattactatatttatgacctgtgataaagcatcaacattcccacatttatggcttatggcaagacatcgaaaatagtacattttcagtatatggcaaggcatcaataaatactatattttcagcttgtgatggagtatcgatagtatcatatttctggtctgtagtaaggtatcaacaagtataacattttctatccttattgagacatcaaaatcatatatagtcctaatcactgcaatcaactatccaaatatacaattcatttttatgcttactgagtaaatataatttaaaatcatattctttgcaaagtttgacgcacaaaggtatcaaaacttaaaaatatatatatattcttaataaatagttatgcaatgagtggttatcatatatcacacaaagcaaaaatcattaataaatgaaaatagcataggtgattaatgtccaaagattcttactgagttattaactcatctcttattattgtacttttttcccccaaagtcatgggacacctaatagaggatagttggagaggaccatcaagcgatggattatttagtttatttttgatattagataaaccgttagattatgtagctaaacaaattttactatttgttaatgctaaactatttggttggattattatagtaatgatatgtttgatttaaatctctagtattattaaaattttgttcaacctataagctttgaatgccctctagagccctgtagggccttttgatcatttcatgtggacaaccaatgtgagagatttgagatatgatagaaatgatatcaaagcctaagtttagctatcctagaatttaagttcaagatgagtgtaagcggatggacctctagcttgaatataaattagatcattgttataattatgagatgtctcctagatatttaagtaacttagatcaatgtatttttagcacttatatttgaatatgaatagatttgaatccttagcctgatgagaatatcgatgattaaatgagagagtatatgatgatccatatgagtgtgttttgtcttacatttagtttcattagatagatcttagatacttatataggaccaaaaatcttaaataatatctttcagttagttttttcgagtgaggtcctacgttgtgataaatgatattagagtagattgagcctatgcccaatgtatgctaggggacattacagcatgggcctagtggcctgattatgggcaatcatagtatttataactagatttgtagtatttatgaatggatctagactcttagctagcgatatattgaggattaaacaaaagaaacttgtggggacctgtataggtgtatatttaattttttatcagctatgctctgaataaatcctagacgcttatacagggctagacaacctaaaataatgcctttcgattagctcttttgactgtggtcctaggtcattacatatgatcaatcaaattttgatgaattatgttttatgatcagtcagatttttgggaactatgcttccgtccaatggcgtaacttggatttgatccctaggtgttaagaccaaatgcaatggccttgaaaaattacatttatatctgagcattcatgattttgcctaatcaaaatagaaagaatccacgagagggccatggaatcccgctatatgctggcatgaattatcatgtatgaaaaatttgtgacgtaaatcacacgctcattgcagtcaaattccatgctacagaagtagcaaacacgcaaccttggtggaagaaaatggaaggactgaagacttttagacctggagggaaggttgttggtcaacctatgtggtccctggacaagtgaataaaaacaagtggattccatattcaaattacaggagggagaataatatggcatataaatcagcctccgtatcataaataaacatctggcaagtaagtttataaaagtttgaattcttgacagttatatatttactattaggaggaattcaaaaatagaaaaataattatggcaaatttaattcaaatataaaaaaaaagaggtaatggctcatgaggaaggaattacttctcatctcttaatttttatctccaaccgtaatcgattcttgctccacacctatataaacaggaccaacgaactccaagaaagacagactataagaaaaaaagactctcataactcaaagctctaacggtgagaggctcaaaagcgctcacccatcatattcttttctttctttaatatagattcgtaggtcatcagaaatctaagaagattgaaaaaatcaaggaagctgagaagaccgagaaagccgaagaggctgaaaaggccaagaaaactaatagagattttttatgtaatatttcagcatgatgacagtaatgctatgaaaaatataaagttcatgttgattatctttttagcttgtagaattgcaaatgatccaacattctcaaaagcagcttagtattggcttgatccagactgagacaaacaactgagctcaaagaagttttgaagcttgttctaccaaaaaaaaaaagaagttttggagcttgaatgatgaacatgagtcaacaataaaattaatatgaaactcggttcatttcggttaaagcttgggtcagagcatatctaagttgagcttgaacgaataggaggacgaggataagggcaagcccttgcttggttacgatcacttattcttatgtacataatttttttaggaaggatattatgtgataccataaaaaatgtgtttgagtttgactctaagcatccttgagtagactcgctcattggacaggctggattaggcttgggccaagctcagcccaaggatccagatcgtttagtcagtcccgggttcggtcaggctttggagcaatgagcatggactgggcttccatcccgtggtgctcaagtgactcacgctatttttctatcgtgggggtttccaacagtgaccattaaaatgctataatagcataattgattacctctcttacaagcgcgtctgtgacaaagataaactaactgtaacaaaaaaaaaaaaaaacaaagataaactagtcttctaaactatatctgatgcaccatttcagctgtataccatgtcagtctgttttcgcaacctcagcttaagaaaaacactaaaaaataaaagaaggaagcacttctcggctcctctccgggctccgcccactttcaaaaccttaggcttagcccggaccgtgtaccgctgcaccactctagcattcgacgaggagttcgccgtgaaatacatcgacacggccctcctctacgaccctctcaaccgcgatctcgccctccgcgaggcctagatgcacccgctcgcccggtctagatccacttcgcctacgagggcgtcgactccctccgcctcgtcctcgacctctgcctaggccctgacctgttcgcccgcatctgcggccgtgccccgctctccaagcatgaggtcgccgcgatgatgctcccgttggtgaagacgatcaccacaggccaccgatgggggatcgccccccgagatgtgaggaggggttcctatcatggagcgctccctttctttctttgtttccattaagctaagatggccagaatagccatgtggtgaaaatttccccttcttgtcgtatcatttagaatctaagatctccggcgtcctacgcccatggcgacggaaggcgaaacatctgacctcatctcttcgacctcttcttgatccagccttcgcttcttcttctgtcttttcttccccttcccatctttctcggtttcttgattttcttgaaatttggatctatttttctccctccgttatttcacttcggtatccagaattttattcgagaaagccaatgtacattgttaagccgaatttctttattttattttattttttctgtcgttaatcctacctcttgtctttcttagatttggattacggttgttacataattatccctttctaaccccttttagaatgacttattgttggtctgaggaacatgatagatatgcttcgttagccctgatattttgcgttgcctttggccgcggtggaatataacacctcgtcaggccttcttgaattaaaggagttgcatttgtttgataatgggaagcgtttgttgaaagcttagctttgcttgcgttcagggaagaaggagcatgtcgacggccaggaagagatcccgttcccagagacgagcaatgcagttgcgaagaaaatatttgccgcataaaaatgcactgcaccacatggttattctttaccagctacaatttatttccttaccatgttagtaatgctaaaaattcaagatttcatttttgttggctctcattcatcgaagacatgtttcacaagatagttaagaccgtgaaatttgatttttggttgttcattacataattgttcttttcttgaatggttaagtagcaacgagatatgcccaaaatgtatcatggtaaatgctgagtgttgtttgttgcttggcctcctctaccaccggtttcctatgttccaattggaacatacacggctgggagtgtgtgcgcgtgtactggagtcgtaacgagtctcaatggaatctgaaacatgggtgaagcatactctggtcaggaaatttgcagagtttgtggttgctgtaaggtgccgaccaagcatcactatgctctcatgcatatattcaaactgacaaagactggggttgctccagatgagttctttgttgctttcgatagaagggattttgacaaagcagaaagatataaacaatgtttagaggatgatctgaaaacttcctattaagaaatcacaattattatctttcccagttcctgatctaatcattttgctcgactacagcccacatgggaacatttatggaaccatccaatctttgtaagaaaattgtgatcatgtagtgcaggcgacgatcatcatacctgatttcatatgcacatggttgcaagtatggccattcaaattaggaagaaaccggcgaattcacttctacatgtagccgccggctttagattgctgcaaaagtgctccatgcacttgtttgaggaggtcgagtggagtaatcatagacgaagactggtcatgggaaatttctattgagggtcacttccctgcttcagaaattcaccagaaactagaatgggtactcacttcctaagtattgtcacgccccaattccgggacataacacggctatgctaccaagggatggacccacgataacacgaagccaaaatttatcttcttaaatataataacaggagtatcacaaataaatgtaataataaagttcaattcaaatatttaattaaaccaaaactggttcagaatatctaaatccaaagataaaataattcaagtcttaaaattcataatgactacaatctataaacataaactaaattcctagtgcaaaatttttaagcttgctcaagcctgaattccctttccatcagtcctagccttatttctctgtatatgaaaaagaaaacaaaaagaatatgagctatatcagctcagtaagtagacttccgcttccttaccggatcaagcataagttttctatgataatgcatcatttagcaaataacaattattgtaaaactaaacatttcatagagcatataataaaacaagttataagcttatcatgcatgcataaatcatgtatatttcacaattatgaatcgtaaatcattttcatcatgtattcatgtcatgtttcaaaacattgctcacagacattcgtgctaaggtcactattatacccgtgacagggccatatttcttaatcgtcagagttcttaatttatgtgccaactttatatctgctggcagggtcatgtttcgtgtggatgctagctctggttgtcgacctgcccgaagggaatcattcatagccatctgagagcctttgaaatcattttatctttttcttaaagcatacatatacatagatggaaaaatcatgaaattcatgtttcataatcatgctattttcataagacatattcatgaaatcaatgctcataataaaatatgctttttcatgtcacatatgccgatccttattttataaaaaaaattatgattttatcaatagcaattctttatataaaagcatgatcatttaaaaataaataaggagcataaaatccacttacctcgatcgtcctaaactttttaatcttccttaaaagaatcgaacagtcctatttaaaatattaaatcatcaataaattttatttcatatatttaataaaattacataatataaagaaataaccgatttgatgatcagtttaataaatctctcccttcggctctaaactgatttaaggtcattggtccctaggagtggagaagatagcctaataagaaattcataggacttcttagagagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggatgggggttcttatagagctcgtcctaggatcttttaatggccctaggactccgattcttgatcgaaatcggggaagaggaagactccgatcgggagtcttcctccctgtttttatttttttttattttttattttttactgagcttagtgggtcggattatcacaagtatttccttcaaattctttaaaaaattatttccctgtatccacagctgcacctgctcccgattttggcaaccaaggttaaggcatgtcatacctagcgacatggtgtcgaaggttgagcctctcacaatggaatcatccgaatacatgaacagaatcttaaactttgcgaaaataatatgcttgttttctattacaccttacagactctactcatttgaccgcatgacttgattgttgactaggccgatatgactgaatatttataatttttcccattagactacagtttcttaaacttactaacttttaggatgtttattgtgtggttgtaaactttatcttgggacctttattttttggggccacgatggtaacaaaataccatttattagtgattgttaattcttctaaaacagagtgatcagaatttcttcaagtattcttatcatgcgtagttattagtataataccagttctatcaggacaaaagacattttttctttggtccctttccttggctcttaggttgatgtagttcatacttcaattgcccaacctaattagagcaaagatcatctttgcttttatgcatattctttttattgtctatttggatttacaattgtgtatccactactgttacggtctggtcagctaggctcataagaaaggactggctcccgaaatgcgtccatagcccatatcgaatgtaaggtggccccacccacctatgtggtattgttcgctttggacatccccgtagggtccccacacgactttgtccccgtggaccactttgcggaccaaaaggcacctcacgaggtcatcatgggtcaagccgtagcactggacccgcatgagacctgtctggggtattgtcccttctaggagcccatcaggacgaacctcgtatgacgtgggtccctcaaaattttgtccctattagctcagtggcaggccattgtgctgtagggtatctcataaggggctagagagtatcacaagccttataaggcgaggtggcctgattgaacaactgatgtgggactaaagtccacactccctccgcaataatagcccctccagtctgcttagtttgcaaattcctaactgactatttagtcttgccgacttcactatttagtcatttttatagaaagataagtaaccaaacgtaaaaggaaagcatacaaacaaataaatcaaaaagaaggataagttaggtaaagcgactcggaccaatgcaacgatgaactcccttcatctgattaaagctacgcaatcgggctcgagagttgggggacaagtgttgggatagatcctcatcacttagccgacctcacgaagtcatccggaggccgacctcacgaggaagccgacatcatcacaagaaggtcaatctcacgaagtcatctggaggccgacctcatcagaagttattcggagaccgacttcattaggaggcggaggccgacttcatcaggagactgaggccaacctcatcagaagtcatctagaggccgacctcatcaaatgtcatcgagaggtcgaggccgatctcatcagaagtcatccggagattaacttcatagggaggccgaggtcgacttcatcagaagatcgagattgaccacatcagacgtcatcagaaggccaacttctttctcaatgtcttactgactacccaaattgatgactgggtcgcacgactcaatgggctccttcaatcgactttctgatatgagcatcagtcgaacggtcgaacgacaggcatggccgtcacaccatcctgataggccacatcaggtcacatcgttcagacgtcacatcctgaccgactagctgcgcgctatgatgggatgttacgaggtcattaattacgtcgcatgtgtaataaggcctgtcgtcacggccacttatgcgtcaaacaaaaggcacgcccaccgtcagagccatttaaagatatccacacggtaccatatagctgacaggacatgattgacatgatcatctgttctctcactatccactttgctccttctataaatagaggtatgcggggactcctccaagtatgttggccaacatagtgccaaaattctgttactctttctactatattgtgtcacctcactgacttaagtatcggatggtcctcactggagccacctctggcaggactttctttgcaggtctctctcttccgacgctaagtggagactagcgccaccattcaccggcaacccctcgctctcatcttcggccttgactgtatacaccttctccgacgatggcataccgtctttcgatatcccatcggtccgcatccaagtgcagcacctagtcagctccaggctgactatcccaaccgaagaaaggccgcaacagtttggtgtgccagaaaggggggaatcaagcaaaaaaaaaaatctctctcaagaacctccatggccaagatgagagtacaaaactcctctgcaagctctgctcaatgctcatcatggcgtggcgtgcctccagcgactcacggagagccgagtgcttcacgaccaccgataacagtagaccaccaacagttcactgctctcatgcaataggtaaaaaatcttacgaaggtatccacagtctccagtagcagcagcaccagccagaggagatcgcaccgcataatgtgcctttacggctgatcatcggacctgatctctgatctgtcatttgactcaacactctcactggatgaattctcgacccacctgatgttcactacatcctgactcccaatgcgctccacgtatcagctccgatgattgccaatcaccttctcgacgagcttcatgagaaggccaacatcatgagaaggctgacatagacttcatccggaggtgacctcatcaggtcattcgaaggccgacttcatccggagaccagtcttatcaggtcatccgaaagttgacttcgtccgaaagctaaagagaaaatttgaagaaaatctccgacaagactgacaaattcgaggagaaaatttgagaaagtgcacctcaccaggaggcccctacaaaatggctaagcaccgagatttcagaaggcagacgattcgaaaaatctataacataaccattccctcatcggctagtacccgacgaagcattagtcagctgacacccaattgacgaagtcggggtaggtccgtcaaccacgagtgcacccccaaggggccgcagcattggattgaacacggatgggttcgtcgaccgtaagagcacccgctaaggctcaagggctgtagcactaggttgcacacgaggcctacatgaaataaagccatgagacacatgcggcctatgcccacgcaggtggctacggccccacatgcggccaggcccatgctgtcaaagtgaacaatttttcgtacaagaatggggccgtatgtggttcgtcccgctcgttttctaagtcaccatgacaaaaccctaaggcccccacagcggcgagatactgttcgctctatgcatggctaatcccctgtgcacgcggccagaggggataatttctccttaggacaaagttgtgcggccccatgctggcaatgctgttcgcatttatgcgtggctaaacctcatgcggcgtcaaagcggacaatacctccacatcggaaaggagccagatccaacctcatgaggtcaggattaatccgaccccgatctctggtagtcatcaaggtccccctccaaacaatgaatcaacgattcgaaaagctcctccaaacaaagactatgtttcggttcaatgaaacaacctacgacgaacaatctatgactatgacttcaatccaatcaagttcatctgtaaaaattgattacatgacttaaaaaagatttttcaaatctatacattcggttatcctctactcagtttgtaactttctaaccgactactttacttagtcttgccgacttgactacttagtcatttttgcagaaagaaaaataagcaagcggagaaggaaagcatacaaacaaataagtcagaaaggaggataagtcaggaaaagcaactcggatcaacacaacgatgaactcccttcatccgattaaagctatgcaatcgaactcgaaagttgggggtcaagtgttggggtagatcctcattgtttctcacgaagtcatccggtggccgacctcacgaggagaccgacatcatcacaaagagaccaaccttataaagtcatccggaggccgacttcatcaggaggtcgaggtcgatctcatcagaaatcattcggagaccgacttcatcgagaggccgaggccgacttcatcagagagctgaggtcgatctcatcagaagtcattcagaggccgactttatcgaaagatcaaggccgacttcattagaaggtcgaggtcgacctcatcagaaggctgacttctttctcggtgccttaccgaccacccaaactgacaactggatcacaccactcaatgggctcgttcaatcgattttctgacacaagcgtcagtcgaacaactgaacgataagcatggtcgtcatgccatcttgataggccatatcaagtcacatcattcagacgtcatatcctgatcggctggctgtgagccataatgggatgttacgaggctattaattacgctgcatgcatgataaggcccgccaccatggccacctgcgcatcgaacagaaagcatgtccactgtcagagccatttaaagacgcccatacggtgccatacgactgacaggatatgattaatatgatcacctatcctctcaccatccactttgcttcctctataaatagaggtaagcgaaaatctctccagatatgttggccaatacagtgccaaaattctgctgctctttctactatatcgagtcaccttgctgacttgaacgtcggagagtacttatcaaagccatctccatcgagacttcctttgtaggtctctcttttgacatcgagtggagaccagtgccatcgttcatcagcaacccctcactctcgttttcgaccttaactgtgtgcatcttctccaacgacagcacaccatctctcggcatcccgtcggtccgcatgcaagcgcagcacctagtcggcttcaggttgactaccctaatcggagaaaggccgcaacaactaccattcttgggcaatgttgcttgaggttaggtttgtaagaaacctgattttttaaatctctcttgtgcgaatcttaaagcaaacaaaaaaaagagaaaaaaaaatgaaacccttgcacttgaggtggaagaggactcccgatggagtccgtcttccctctttgagtccaactgaaatcgagactttaaaactcatcggaactctagaatcccacctataaatacctcctctctctctacacatcactcaaatccgcagccaattgccggcgaggccattcgatttctaccaacttccattaggtgttccttgacaaattgccgtcaatttctcatggagatgaggtaaggatcctttcttcttcttcctttctttttcaaacaccacaaaacttttgatggccagaatcggatgctgattgtcggatttcatgggggactcgacctcccctgttcttgttttcctcttttcttttagccggaccagctgtcatctccgagttgcggccttggtttggtcgccaagggtcggagacacccctaccgtggccgcttgaggtgctaccagagaaggccatggtcgtgggggtgggttggcctcaattcccctgtttcaaagaagaaagaagaaaacaaaagaaagagaaaaagaagaagaaaaagaaaaaaaaagggaacaaggaaaggaaagaaaagaaaagaaaagaaaaaaaaaagagagagttttctctctcttctctctcctctctttatcttctttctctatttttttctctctctaatttttctctatattttttttctctagaattttctctctctagattattcctctttttatgtaattttctcgctatggttgatctagtaaaagatttcttctaatgatttggatctgatccaaaccatgacttggatcgagattctctctttgtttgtcctaattctttttcgattgaaggctaagaatatttcacttgactgatcagagtctttaatgctagagaagcatcggatctagagatcaagtcataagatgaaggtcgtgatttttggatctgattgattgtaagtttcttcttatctctgagtttatctttatatatatttatgtctttaaaaataaattttatgcataaaatattaaaaaaatattaaaatttgaaagtatgtatttatatataaaaaataatttaaaaaattggatcaactatgatgtcacctttgcatggtataaatttttgaaaagagatgatttttttgtattaatattacatgatttctagaaaaaaaattatatatatttatttatgtataaaatttttaataaaaattattttattgctcttttggaagacatgagaatttgagttgatactgtcataaaaataaatatgattatttatgagaaattgagtatgataaaatcagaagaaaaattctctaattaaagtatgatctgaatctagccaaagagactgatcattgaccacatgtcagaaatatattttttttggacctatccaatcagggctgatcgctggtagagttagtctttctgagcctagccaatcaaggctgatcattggcacacgctgatacgtcgcatgtttcttattttaggactaatgtcatggggcgaatcatgaccatgtgggataaagctagtttccctcctgagcctagccaatgaggttaatcactgatacatgccgatggatcggatgttctatatttagaggctaatctctcctggaccttatcgtgggactgatcatagccgtagtcaccaaaaactaagagagaatttttggatatttattgatatgcatgatatgttttaaagaaaaattatcttgttacatatgactgtaatattgttatatttttgaaaaactaattgtggttgatccctcagagatattgatgacttactcagcccgtaaaactcaccccattccttttttttttttcagatccagaaatcccaaagggctggagaccaatcagtgagaagtataggatcttagtaggataattatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttataccctacatatgatgtatcccctcaacggaatatcctgccaatccattttcaccacgtggctatcctgacgacctcagcttgaagagagagagagagagagagaagagtgctttccgctcccctctgccccatcgaaaaccttaaccctgtgtaccaaagaaaataaaaaaaccttagaccgcatcctctgcctccgcaaagccacttccctctcttaccacaataaaaaaaaagccatttctctctccacccaagtacaagcattgccaatcgacatctgtacgtggaacccactagcgtgaatcagatgggggagaaattattgcttggaccacgcctaagtagaccggtgcacatagcatgtatacgacggataatgtgtaatcgaaaattttatgatatacaaaggttaatatagtgtattatccatcgtgagatttggatgacctatttaaacatgatccagacaataatttttgaataaattataaaaatatcctctcaaatttaaatcattttcatttacaccccttatactttaaaaaatatcaaactggtccttaaagttttgaaacattctaacgagatctttccatccatctatattaataaaatcttgttacatgaccatcacatgatattattaatttataaaatgataaaaataactttatgttcgcctcctccttctccaattgatctcctcctccgattaacctccacccattcctccaccgcctccctttcctcctcttcctccctcctctccgattgatcttctccaccacctcttcaagatgctgacttttctctcctggatctgttggatctttcccaactccattttagcacatcagttgggatcagaaatgaagggcctcgggattgcagccatcaggctcgattggtcctccatatgtgcttatcttggcagttcgtttgccagtccctaattcgccactgctaacatcgccattagcaacccgcttgccagccctcatttttaaaaaaaaacactttgtaggcctaggacatctatgtttaatcttgatgacaatagattaccttaattcttttcactgttagttctcaggtcaagtatatgagtggaagttgaatttgttgctccttcaaaccatccatgttttataggtttattcaaatcagccaagctgtgatctgacaaactattttatgtccatgaatcttgtgccttagtgtcctttttgcatttaagaccctcaccagtgcctaaagtaagctttacatcattctgaggatcagagccgcaagttctactaggtggaactgtaactctagatgatgaagcaaaacttttctttcctgatcttttagaatcttcactgtcaatatatacatctactagaagttgtagatcaaacattctcctaagaaacttctgaaatttaaggtcaagaaatttaacatctttcagagagtccccattttttattgaaatagcatcaaactgcacattactttccttcagaaagtttaaggacatcctaatgccatcagcgcttgcaaaagttgatctgtcataactgatatttactataggcaggtgagacatctgccacatttttttggtaccttcacatggcatttgagatgaaaaaaaatttgactgagatgtattagatggtacagaatatccgtgtagccccttcactcatccgttaggtccctctgtattctataaagacggtgcagttcatgatagacctaaattgcagaataagactgcaatttcagtgatgacaaacttatagtattaaacaactaattcatatattatgaagaagacaagaagagaaactgaggtgtctatgaagaaatggactgccccaactgccattcattgttgcaaaaggaaaacaggagagagaagtcgaaaaaaggtttcatcatcgcctcaacaggaaagatattgcaagataaagagaagaatgcattcaaaatagagaggtcttaaataacagccatggcatatcgtggaagagggcagctcttgatagcaccagagcaccgaccaactcttcctggttcctccatcaagtctcatagctgagtagaatattgggttgaaaacacagttgtccaatgaatcaagcagcttgagcgtctctagattcaatttgagacaagcacgaatcaagttcggttcaaagcatgaatcaagtagaagactcgtatgcaccaaaaagaggatttgatgccatttggatggtagtgacaattctgagaaaaataaagatggcaaatatcattgtgacaaaaccccacaaaaacattataaactcctagagcaaaaaaaacttcaacagaagaattctgatttgcaagatttcaaaacacaaatatcataaaaagtattattttcggaataaagaacagaacaatgaataagttacctatctcagaacataaaaaggacacaaacaagtggcgatagactcagattcaccttcgtaccatcattccacttctggattatttatctacaaatggcagtagaggttgttaggggagtctcacaatagtcacaaaagaaaaatactagaggaatctacaaaagcttcatcatcaatgcctccagagaaagatagagcaagacatataaagagaggtatgggaattaagagctgagttcagacaatctctagttcatgactgaggagacaaccatcactatagaaggcactctggcttgcccacaagatttttccaagacatcaatggccatcccactcttcaccaccatcatcgcgaagccgcccatcatgaagtccatagctatcttccccaatggcctcaccaccaccttccctgccacttcagtggtagctccgaccgaagccaccatcctcctatcgttctcttccctctagagaggagaaaatttcaatctccatgtagaggggcatttttgttcattgtaatgacaagcggatgccgtcagaggttaagtgaccatgggggcttctttgaaatgtttcaaaactttagggacccatttgatattttttaaaatacagagagtgtaagtgaaaatgacctaaatttaaagggatgtttctgtaatttattctaatttctttgacatggtgtaccactactattctctagccattgatgaggtgttcacaataaaatccattgacaagaccctcctctctgacccccttaccacaatctcatcttccaagaggccaggatccactagcttgcctttgtgaggagctctcatgccatttgtaaccatgccgcttatgagaatgccgactccctccacctcctcaacctctactcaaggctcgagctgttcgcctgcatctggatgtgccccactccccgaatgcaaggtcgccatggtgatgctcttgctgatgaagacaatagccgcatgccatggatggaggataatccaccaagatgtaaagaggggtttttcatcattgagcgctcccttttttctctcatcagaatggccacacggtgaaaacagattagcctagtgtatcgctaaggtggtacaaatgtatggtataatttcccttatttatcaaaaaaaaatataattttgctttttggtgaagctaatcagcatcatgccatggcaactcatcagcattatgttggttttggagaaaaattgaaaacttaaaattttctttatctttttccaaccaaacctctagtttccatgaagtttagtcccatattagaaagagaaaaaataagaaaggagtttattttgaagactcttctcttaggcctttgaacatgcacgtgcagcccggcccggccctgctcgcgcatgatcacgctgtgcctacatctgcggcgtggtggggcctatattttatttctccaatctttatttttcctgttttaactttttcgaacattatattttgcctgttgaaatttgttaatttgtttctgtccgtttatgatcggttaagttgtttccttccatttcgtgatttgttaagttgtttccgcccattgtgagtggatggttacaagattaacattggattagccagtctgtaggcctataaaatggccctatggtggagggatttagtagaaaaaaagacttgctcctcttctaatctcattcatcttctctgccattattttttcttaaaagtctttcttgttcctttgatcattgatctgctagtcaaagctctgtcatcttctctatggtcatacccacaggggagatcttcggttgtatcttgagatagatttttcaagtttgatctgcacgaagatcaaaaatcaccttaggacagtgcactacccacttccaatctgtaagctttagattgatttagtattaatcttatatttattttatactaatttaatgttaatatttgtttgttagtttaattagattgcaatcgactcttgcagaaaacaagattcctaacattctaaggcgaatcttgttccgattgtgatttatagctagcatctatcaaatttcttagcataataattattttgtataatcaattttgttagagatagtgtaatatttatgtcatcttaactttctcatcttggtataataagtttgagttaatgatagtatttatttttcctactaatggcctattaaaaatttgataattcataaaaaaacttaatttgctatttaccagttctattctacatttaaatttctatttatcaattttgttctgtatttaaatttctatttatcagttctattaaaatttttgtttatcagtgttgttccatattaaaatttaattaaatttctatttatcagttctattttgtattaaatttatttcttactattagtagaaaaataataagtccttacagataagtcagtgatatggaatcagtaaaatatttcgatatatattttttgcagctcttttctcttatagtcttgtttcttagtcttcttttgagatttttttctatgggttctaaagattcttctagtcttaaacctgataggttcaatggaaaagattttcttaagtggcaagaataattaaaagcctgattgatatctttaaatttgcttgttgctttagaaaaatcactaccatttgaatcatcctcttataaagattctaaatcatttgaagagatagattattactgtacatttagaattctaagctgcctatctgatgaactatatgaaatttatagaaaatataagatctctaaagatctttggcaagctttagaagaaacctatatccgagtgagttaatgagggggctataaggttcatcatttttgactttcataattttaaaatggtggacaatatgcctatcaatgatcaaattcatcaatttcagaatctagtccaagagatttatcaaaggaaatctactttggatgaaaactatcaggtatcatgcttgatagacaagcttccaccttcttgatctcaatttacccatgactttagaagaccgctatcttccctcaaccttaggtctgttttttaatctattaggatagaagatcaatttagaattagagagattcaaaaaaattaagaaaattattttcaaactaaggttaatcaactgaatctcaaaacccaaatccaaatcctataggttaaacttatagaggtcaaagcccaaatttcaaagctaaagaaaaaaaattaaaggaaagagtaaggctaggttttaaaatcaaaagctaggtctaacaatcaaatccaaaaatcaaggaacaagataatgagaggtctgctttgtcagtagtcgggacacctatcttacatccaaatgttgctactagaaaaaggagaaaattttctataaaaaaaataagaaaccaaaatcaaactaaactttagatcaacatgatagaagaagaaccatcttcttttaggtcagtctctttttctccatctatcaatttaacttattcagatttagagtggtggttagataccggagccaacatccatggatgttcatataggtcttattttttatcatatcaaaaatcaagaggaggaagtgtaaccataagtgatgggatagctgtcaaagtttttggaagtggaacagttaacttgaagtttacttcaaaaaaaactttagtttttcgaaatgtgcagcttatatccgtcataagaagaaatttgttaagtggttctcttcttgttcaattagatttcaaggttgttttaaagtctaacaaaattataatttctaaagaaaaagtctatgttggaaaaggctttgtgtccgaagggttgttccagttaaatatattctctccttccaaaattaatgaaagttcagttagttcttcttcatctgttatgctaaattttgaatcttatagaacatgggatggaagattaagacatatcaatcttagatcaatcaaaagaatgtcttatcttaacttgatttcaaaatttaattttgatcaaaattcaaaatatgaaggttgtgttcagaccaaacaacttagaaaatcttttaagcctgtagcttttagagatactcaaattctcaaattaattcatagtaatgtctataattctaatagaggaccaatccatagaggtaatcgttattttgtaatttttattgacgacttctccaaattttgctatacctatcttttaaaaaccaaagatcaagtcttaaacaagtttaaggtttataaagtagaagctgaaaattagcttgaaaaaagaattaaaatcttaaagtttgatcgaggaggtaaatatacttcaaataaattaaccctattctgtgaagaaaataagataattcatgaagtcactactccttattcttctcaatcgaatgacgtggctgagcaaaagaattgaatcctattagacagtcaatactatgattataagttctggtatatctcaaaacttatggagagggctcttctattggccagctatatcctaaatagagttcttcttaaagatagagaaaagacatcctttgaattttggaaagaatattcttttagacttagttactttcgagtttggaggtgtttggctaaagttaaaatttttgaatcaaagagagttaagataggacctaaactgttgatgctatttttgttggctactctttagatagtaatacctatagattttctattttcaactctgaaataccttcaatatcaaacaatatcattattgaatctaaagatgctacctttttcaaaaatatattttttttaaattcagatttctagatcaaccaccgatcaaccattctctttagatttacccccatcatcatcatttattcctattttagtagaattaacttctgaacctaagcttaggagaagtaaaagaattagggttgaaaaatattttagtgatggcttctttatcttttcgatagaagataccccagtcatgaactctcctgatgctctattctagaaggaggcaaaaaataatgaaatcaaatctattattagaaacaacattggattttcattgatttattttctgagaacaaatctttagggtgcaagtggatcatcaaaaaaaaattgaggattgatggtacaattgaaaaatacaaggtaagacttattgctcaagattttggataaaaaatcggtattggcttctttgatacctattctcctatagctcatattactactattcgagtcttacttgtcttatcttccattcataaacttgttgttcatcaaatggatgttaagactatctttctgtatgcagatcttgaagaagagatttacatgcattgacctgaggattttttttgtgttaggccaggagcataaagtttgtagacttgttcgattcctcaatggattaaagcaagttcctaagcaatggcatgaaaagtttgatgaaataattttttttatggatttcaaatcaatgaatcagataattatctttattataaataatttgatgatcgattcattcttctttgtctctatattgatgatattttgatttttgcttatgatattgacttaatcaataatattaagaactttttatcacatcattttgatatgaatgatttaagtaaagctgatacaattcttgatataaaaattattcatacttctgatccaatttatttatcccaatctcactatactcaaatagttattaataaatttggatattctgattctacttatgtatttactccttatgatccttccatccacctcttaaagaatgcatgaaaatctgtggatcaagaaaaatatgctcaaattattggttcattaatgtatctatctaatcgaactagacctgatattacttatactatttctagactttgcagatataccagtaatcctagtctagtttattgaactgctttagagagagtattccgatatcttaaaggtactacaaattattctttacattttgtaggttatccagatatacttgaaggttgtagtgattcaaattagatttctaatatattagatattaaatcaacttctagctatatgttttttctagaaaaaagtgttgtttctttataatcttccaaacaaacaattttagctagaagtactatgaaaactaaagttgttgcccttgattctatctgttctgaagctgaatggttaaaagaacttttatctgagattccttccgtatcttctcctattcctctaatattaatttattatgattcaagagctgcaatagatttttgtaaaaaaaaatttgtaaatgctaaaataaatagatatattaaactaagataaaagtctgtaaaagaaaagaaaaacttcaaataatttttttgaatcatgttgcaactaaccttaatttagtagattatcttacaaaagacttaaataggactaagatcctaaagtcatcgaaagggatggggcttagcctataaaggaccttccaattgtgagaatccaacctctgtgataagagattccttgaaggaggttcaatgtggtaataacaagctgattggttggtcaaggagcacatatgatttatttgatataggagtcataaatttcagtccatcccgatcactacaaaaaattaaggtattaacgagagccattagcgacggcatttttaccatcgctaatatgcctataagcggcagcattactgatagcaacaatttcgtcgctaataataattttatcgaccgctattagagacgatattttcactgtcactaatattagttataccaatggtgtaaaaggtattagagacagtatcgccgtcgctaataatcaatagcaacgtcattattagagaaggcattcaccatcgtaaatttttttttatttgttaaaattattagaaatggcgaaaagaatattagcgatggcaattgccatctctaataattattagtgatggcacttgtcatcccaaaaaataaaaaaattatttattaaaattatttgtgacgatgaaatgagtattagcaacggcaattgccatctctaataatcattagctatgcactactagtgacggtattcgctgtcgtaaaaaatattttttttattattaaaattattagcgacggtaggaagagtattagcgatggcagttgctgtcatcaatattcaatgcagaattattttttttatttttttaaatattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatagttattctatagtaatatatatatatatatatatatagtaacgtatcaagtgaaaggagtggtttaacgtgagaagtgagaggacataataataatccttagatccacatcaacagttcagatgagaatgcagttgtcccaactatccaaatatatcttgatgaagatatagtagtcccctagcaatccctcaaatgatgttgggcctttgttcccagtttagttgttcgcttttggctgcatctagttaatccagatagagcatgtttaatgttatgtaccattgccaaaatggttaatttattaatttagagagatcaagttgtatgctcattgaaagagcattgttggtttggcactgtagcttatacagcttcttttgactatccaatttgaccttgagtagttctacaagcctagtcttcctgagaaaccaaaacaaacaaaattctgggattatgtatcggctattatggaacttcttttgagtgaattctgttcagaacttcctactatttttgaagtttttttgccctcttgttttgtgaatatgggtgtcttctctatgcatttggaagtacctgcatgaagcttttgtgagcattttcattttatatactcattctggcacattttaagaatatagtcttgttttcatatctagcaaacattcttgtacgtcttcacattcttatgatatgtgcttatattatgaacatttctctttgctttgtctacttcatagattttcttactaagcttattaatcctacattaattgacagggatttagcaaaccagttttgacctttaatgtcaaacatacatgtgtatgctctttcaatcatatatgttctgttctatattttgggtctcatcttggtatatggtttattataaagttaacaatcataaccatttgtaagcataaacaagaagacgtatcccatcaagtttgggtcacttatttaggaatcttactatcccattggtccataactccatatgctagccaagcattctgaaatgatcttgaagtcatttctcatatgacaaattaaaccttaaattactaaatatgtttcagcagactttgcaagcagggtttattagggacttagagatatctaagcaatagcaaaagtaccaaatataaatgtgtcgaggctcttattctggatgtattcatagacaagcaactgctcttgctcttccaagcaataatccaacaatctttcaagattcttatggtgaagttgagcaatgaaggccacttcatttcttaattgtttgagtccttgccctgaaatttttgaaagcctctttacagctatttcctgtccatctgataatgttccctgttagaaagcataagagaactaagtattatatcaatctgtaagagaaaattaaaagatagcactatacactgtttcttatcaaaattaatgaatcttagtctaaaacgccagtatcttatactaatccattactaccttataaaactgtgccaaaaccaccctctccaagcttatttggactggagaaattattaatggcttctttgattgtaggcaattcaaatagcagagaacttttccttgtaatataattgatttcctcccctattacaaaagaataagcaatataaaaaacctgtgcagtgagcacaaatcgatatttaaagaaagaatgaggaggaaacagcagaagaattcacagggcattctagatatgaatatcattacccaaataatgtttctcataaacatagcatgttttattggatatttattcctcatttacatacattgccttgattttccaaagtattattttactaaataaataaataacgaaaaaccaattatcttgtttgatcatacttgaaacctaggatggtccccattgtttaggtggccacctgaccacctaggtaccttggcacttgttgcatacatggatactagctagtgcagccatccaagcacctacctcagctacctgggtgtttgcacaaaactaccatccagtccttgaaggtgcagctaacatggatatttacggtggccgtaccttgtactaatatctaaatgttttatgatttttataaaaattaaataatataatcattaccataaaatttatctatatgttgagctactactattcatacaaatttagtgaatcattgtataatttaactctgagaatacacctatgtccttagcataaccccaaggactttaaagggcttgctgccctgttttcccttattggtctggcaacgttgtgcatccacattgtctggcggatatttgggtatagatgcaataaaagaatccatgcgcagttatacgttgaatctgcgactgtttaaattgtcaggccggcaaaggagagccataaaaccatgcgaatctgatgtctagtatacagcacattcagtgcacgtggtgatgtgataaaatatggatgaccaggatttagggcatgtataatctctacgtttaatccatgatgatgggtttcttgttcatttatggttgatcaaattattttccatcttttcccaagaatggtgatgcattttggaattcaatcacccatttactatcatagtttattctttggccagtctataaccaattacaagaatttgagaatgtctgctggctacttactgtgtctttttcttcatagccttctgtctccgcaagcgaatgcaaacaaagcatgctagcatgagtatgactaccacaagggggaaaacaataatgcgagttcttgctgcattcttttcatgtcctgcaccaagtgaaaatctgaagtatagctgtgcttttggttatatcatttgaatatttggttaagacatgttcaaggctataattaaaaaacacgaatatggcaagtctactttcctcaatgttgtaaaatagattgcatgactcagatgacataaataatatgattgaatcataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggagattctgcttctgattactcttccattcatatcttgtatcatcttaattcctcaacatctgtaaaaatagtaaaataagagataatgagctagacagcccagtaagtaatgatcactttcaacagattccatcaggcattaaagtaaataatcatttatagaaaataagcatatagagttcatcaatttgaaattaatttcgattatgcaatataattcatgctaaattcatttctttttcaaaaatttgagtttctttcgagatttcaatttctttcattcttaaatctgacattggattatcttcctgaaacgacgtctgatatcgacatccgatatcgagttgtcctatcaacatggcagccctataatgattttgcagccgtcgaaatgataaaatagtcggagaattctcaactagcagtcaagtcgaggctcgaggcaatatgtgatgactcccttcatccaacgtaacaaaccacgttataatcactttggacttgagagtggggggcaactattgggacaagttaatcgacccccgactccaactctatatcgaccacataagcacattatgctgactcacaatcgactgaccgactaatagtcggctaccatcaaccatcagctaacaataactcctgaccgaaggccatcagcatatccgagttatcagccgatgcacattcagatcttctaccgactcatcagtattaccgacatatagtcggtctatctgctaaacataccataaccattatgaatggttatcaactacgtgtcacgacaattaatgagaataaactgcccattaactacgtgattatggcccgataatttagcacagtaaaaagcaagatcacgtgctcgacggttacatcagaatcatctataaaagagagataaacaagcaacacgagtaagataattctgggctaagactctgccactctcaacactcttattagctgttcaccaaccccctctctgacttaagtatcggagagtccccgccggacacaacttcggtctgtgaggactttgtcttgtaggtgttcttcatcgacaacagaagacggagagttagccgcaacaacttcaatgacacaatcatttggaggctgcaaaactagagagtcgtgtgcatgccaggatcatcattattttctaatatttacttgtttattagaatatctaattacctaaaatcaggaagaattagtaatcttactttatttagatgccatctagaaaagtttgatgctaaactacatcaagttagatgaatcctagtcacgtgagaattagtaagcttcctttatttagatgccatctagaaaagttgctagggcgcctctctttggcaatataatttgaagttcttgctactagaaaatattagacattttttcttaaaaaaatgcactttgcgcgggtgtccataaacgttaatcttctatttcttccatctgattgtcctcttcatacaatagacttacatcattgtcatgcctacttactaatccgatagcaatcatgcatcagaatgcataatggtttagtcctgtctatgttttcattaccccctagcttgaagtcgtaacttttttttttttggtacaaaaggaggcgtgaagcctggattttgcaaggaggccggcacctgatcattttcttccagagtcatatcagcatgctgagatgccgaggccagccggtcagccacctggttaccttgtaaatatgacgagccatgaaagcccatgctgcatcattcatcaaacatggcgctttagcatctgaaccatcaaccatcataccacagtaattaaatcaccttctaaccaaacctgagtggctttaaatctaaatattgcattccacaaaccctctaatgcagctgccatctcagcaaataggactgtcacgccccgaacccaacactcgggtcggatacgtgatggccacacactccttagagcaagccctaaagaatatgcaaggccaaaataaatcattacaaccttaacatccataacaattaatttcaataataattcataaaacttgcataattacaatttacatttcttcaatcctctgatcagatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggccaaccccggccacccttcgatagcagccgacgacgatgcatccacagcctcggtgacagccccaacgatggctgttgccggtggcacacgaggaagaaaaataagaaaaaaatagggatggccctgttcttcttcaattcgatggcttgccgtcagttgccagcaaaagaaggatgcctaagaaggaagaagagtaggaaaggagcttaccttgcttcgacggtcgagaagaactctgatgacctcctttttccccatctaagaactcacggatcctcttgaaaaaaaatccctcaaatttcttaaaatctcttcaaaataccttttgtagatacctaaggaagggaaagagggtttataggggagctatcctactctaaaccagactctatgggtccgattttatcggggttggaggggaagaagactctggttaggagtcttcctcctcctcccgtcggctctattttgggcttctccaatttcgccaggcccaagagccctatgggctgggccgtgacaatctcccctccttaaaataatttcatcctcgaaattaagttatgtcgttcgagatacatatttcaaagtatacattcttcatgtcattcttaaacttacgataatgtcttatatattatttatttctcatgatcttgttataacaaaaattatttgaaatttcaaattcatctcctcttattgatttctcaactttttgaagaactgtaacattttggacttgtattaatataccacattatttgtctaatatatttcatccgaaattcataattatctcagactacccttgatagaaaaataaataaaggtcaaacatcgggcactcttcacaatcatcgatttctttcttctcttgatcttccaacaaattttatatgcagactctcatcttaagaaaacctcaatcttctatatcagttcgagtaacaatattaaattttaaaaatatgagatctatgttaggactttctaagtttgaactaatatcagaactatcaagctgttaataaacttgagatatctagaatttcttggtattatctacaatgaagcaacttactaacaaaaattatccgactatgatcagatgagatcaaaatttatagcatcctttcgttatcaataaaattcttccttatttacaactaatatatttcatcataatatcttttgatttaaaagattaatatttttaatcaatttaatccaccacacttttactgcgcattctgatcttaatttatcaaattatataggtctatcaaaaataaaatatccttgtatgttagatcaatccaggatacatccaaccttcaaatttcatataagacttaagacaaaattttaagtttttttatctttactacctttgggtatagcatataaaaattaattcttgatccacttcctatgtttgaaatcattgcataagtttcatcactcttcaagaatccaacatatctagaattaattggagttaaccttagatttaccttacaatcatttagatgattttctaaatcaatctttctttttaaaagaattaattctaacttgacaaactagaagaactcaagccaacatccttaagtagaatcaacttgattatttcttatagagctcccttcatcataacccttaatattaatcaataaatccatacaaaattttatctcttgtataagtcattcaaaatttaacactagcaagatgtcttagttcaatttaaaaaaaaaaatccaaactttgacttgaataattaatacacttcaccatcttcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactcgatatcatatgcagacaatcatctcttcatgatcctgatcaatataaaaatcacatatagagaaatttccgataatcgatcctaataacacaaatcgagaacctcttttaggattaatcaaaattaagatttatctaagtatctggatcctccactgatccataaaactttcagagagagaaaatctatgaagagagagaaaattttattgagagaaagtagagagagaaagtggagagagaaaccttcgtatccttcagatgaggcaatcatggtcgagatcatcagagatcctatcagggtgactcaatatgaatcaaatgttataaatttcgaataagatcggattgagatcagatctactgcacgaattttggagcaatctcagatcatcttatttttatttcaattttatcctaggatccgtgatgaaatcaaagaaagaaagacactagcgagataaaatccataaagagagagaaaaaggtctagagagagaatctagagagagaaactggagagagaaggtagagagaggagagaggaaagagagagaaaggaggaagaggagagagaaaattctcttctttttttttctatttttctttttctcttttctctttttttcttttttctttttcttttcttttcttttcttttccttcttctctttttcttctttctttttccttttcctcgtccaaaacaggggcatcgtccccctccatctcctctcaccctcatgcagccaaggagggccgaccccggccacccttcgacagcagccgacggcgacgcatccacagcctcggtgacaaccccaacgatggctgttgccggtggcacacgagggagaaaaataagaaaaaaaacagggatggccctgttcttcttcaattcgacggcttgccgtcagttgccagcaaaaaaagaatgcctaggaaggaagaagagtaggaaaggagcttaccttgctccgacggtcgagaagaactccgacgacctcctttttccccatctaagaactcacggattctcttgaaaaaaaattcctcaaatttcttaaaatctcttcaaaataccttttgtagatacctaaggaagggaaggaggatttataggggagctatcctactctaagccggactctatgggtccgatttcaccggggtcggaggtgaagaagactccggttaggagtcttcctcctcctcccgtcggctctgttttgggcttctccaatttcgctaggcccaagagccctatgggctgggccgtgacaaggactgcacaagggggtaatctcttcccagccgcataaagtagatgatgtaaatgatctctcaaggtaatccgatcacctgctgcagcaacatttagagatccatccaagttaaccttcagcacatcaaggggagggggtgtaacataaataacgtccatagtaaagggatatcgggtgccaaggttactccagtgccttgactttgcgtcaaagaaaataactaagggagcattttttttattttttattttattacaaaataaaataaaaaagtaaaaaatatatttgataactagttgttataaagtaaaaagcaaaaaataaaaaaaatatatgtttgataagcatataatattttactattattttatatattaaaaaataagatctaaattactgaatcaaatcatatgttcaaactaatctattagcaattttacctctaattgcacccatctctcatcgagagttaacaatcctgtcaacatttgtagtagtttggctatgagcatcaatttcatcttcaacgataatattttcatctgcatcctcaataaagaaactatcttcttcatgatataattatgaattgtacatgcagctataacaaactgatgattaacatactcacttccatgcttaactagaaaaccatacaacatgttagcgcagctcccatcccccacactgacaactgccgggggcacattgataaaattgactggagtcagccgaattcccacctcaatcatgcttttgaactgcgccagcacctcagccagccgtcgcgacctgacataccatcctatcagcgtgttccacgagaccacatttctcttgggcattctatcgaacaacaaccggacagtatcgacacgcacacattctcggacgacagaagaggcgtacatgttgaggagggagttcttgagaacacagttcttgggcggtgtcggggagcggcggagtaggtggcagtcgatggacttgctgagggccagttggcaggtgtcagcgcaggccttgagggcggaggagtagatgtagtggtcggagcgaggggcgctgccaccaacggcggaggagttcatgaggtagtagaagcggagggcgtcggtggggagggagttggagacgtagccgatgaggagggtgttccatatgagggtcggagtggggcgggggagggcgtcgaaaaggcagcggggggcggcgaggcagccctccttgcagagctgactctgccgggaccggagtgttgtgcgtttggattcggggtttgggttcgatgtgtaatcggggttttgggggagggagaggaagagaggggaaagtcagaaagaaacaaaagcaaatcttaaaacataaagtaattatttttatttttaaatttttaatttttgtgatattatcaaatattattttttgatttttattttttataatattatcaaatattattttttaattttattttttaaaattaaaaataaaaaatatttattttggtggttaaccaaatgcatctttagtggatttgaaggaattctgcagtcaaatatatatgtatatattttgttgctacatcactcgaagaagaaacgtcctttgaaactgcctcattacttgctttccaaatgagccatccaatattaacaatcatagactttgttttttttttttatctggggctaaaatagaaaattaagtaccatcgatggaggcaaaacatttttggcaccatatatttttaaattttttcaaatttcaaattttgaagattgtattttgattgagaaaaatttaaaatttcagtttcaaatttgaatttcgatgttgttggtctgtcgggatttttttttttattttataatttttttatttattcttttttgtattctattttttttaataaattttagaaactattgtgctactacaaattagcctcattttatatataaaaaaaaaactacaagtacccaaaacatggttacagccgtcctcacagtccccaaataggtcacctgattgcataccagcattcaggatccctcttcattttttttttttttttgattaattcagagtctttcttctgttaagaatagatttataaggaattctgtaccacgccaatttatccaggtaaaggatgaagcattgtgccgataagacaaaggcaacagtatcttgtgcatctcctctacaggagctttaacattgcctgtacttctcccaatatagctgaccagaccaaacagcttttgataaagaaatttcacatatattgtccatcatttcagcaggaaataaagaagacaatttgattttttttgttccaacatctttcagcagtgataagattagccacctttcaattttgggtaaattatgttcataatccctaaactaagtcaaattttttttaaatgattcctaaactataaaattctaaacttaaatcctccaactatttgaacccctttaatatttctcctggatggattccggctgttttctttcaccgaaaatctaatgtggcaaaatccaatgctgacgtggacaaaatccaatgcagacatgataaaaaataatatattattattattatttttaattttttttgttcttcttcttctctctaccctcatatgaatcgcaaagcaacaaaaaaaaaaaacaaaaaaactcctatcttctccttcctcctgaccgacccctctggccgcacccatgcccggcccgacgccagtgggttgcattctggtgccccccagccccgtgtgccccaaggttccactctctggcgcaccccgccccacccccatgtgcccctgcggtttcacttccacattgatgaaggtaggccaagcatttaaatttgaaatccaagggtcatgactcacatttacctgggtactggagcctaccatccaaataaattggtgtggaatagcagcaacgttcaaaaaaatctttctccacacaaccgagcacccacagggtatgttattagcgatccaagattcagagaagtggtacctagcacataccatctaagcccatgaagagttagtctgaggcactagaggtgggacatagttttagctaacctaagtagcgtgagaagcctttactagaggtgggacatagttttagctaaccaaagcagcgtgagaagcctttatcatttgtgcatctgatccattggttgattatttactctacctgttttgaagattttgctacaggataggtttatgcgccctccttttctgtataattaattgccttcaattataaggttctgaataaattagtaaacattatctcaaaggaagtctgatattaggtcatcttattataaaacggaaagacataatacatattctgccgcactaatgtttcaaaggacacgagggtactccatgcattacatccacaatatgcagtcagtctttagggagttgacttcaagttgttcaaaatacatatctacgaccatcttacctatatctatcttggctcgagctctgttattgacgcatcatttagtgacattggtatcgacctgttcgcagagtggtcatctgtacctccgtgagaatcatttgaataaacatctgagatggtgccagtttgtccaatgtaaaatgcaggtcgggagggatcttgaagagaaacagagtcgctgctgagcatcacaacgattgtagacatggtaggcctgtcagatggatcttcctgaacacacaatagtccaatctgaatgcatctcaacacctcgtttcttgggcaatggttacccagagatgggtccaggatctccaaaattgttccttttgtccacttctcccatgtctgcataaggtgaatttaccaagtaaatcatctatcataaagctacggcatgcgtgtgggagtgggtggatgctgttgcaggtgttgtagttttaaaactcacatggttcagaaggtctttgccagattcagaatcagagaaaccaatgtttctcctgcccgtcacgatctctaaaactagaactccaaagctgtacacatctgacttgattgacatctgtccacgcatggcgtactctggtgccatatatccactgcaacaaattggatagcctattgtaatctaccataacaatgggtaaatctatcaagatttccacttacaatgttccaacaattcggcttgtggtgcctcgactttggtctccaccgaaaagtctagccataccaaagtctgaaatctttgggttcatgtctctgtctaataaaatgttgctggcctttagatcccgatgtataatttttagctgagactcttcatgtaggtacagcaagcctcgagcaactccaccaatgatcttgtacctgttcgcccagttcagctgttctctttgtacaggatctattccatacaaaaatagataattaaggtaacacatattagaaagttaggagggttgaatatagagattactagaccttttttgcccctatgctaaccaaaaggatgaagttagaagtgaaacttccagaagataaggagacactaaacccaagcaaatgcataaggtctagaggagtaatagtaggcttcaaatactatgataacactgaaattctaaaagggtgagattgctgtggaaggcagtaccaaaaagaatggtgtccaggcttctgttaggcacgtattcatagacaagcaacttctcttgttcctccaagcaaacgcccagaagccttacaagattcctgtgctggagcttagcaactaaaagtaactcatttttcagctctcctaatccttgtgatgaacttgtcgataacctcttgaccgctatttctcgtccatcaggtaatactccctatacagaattataaggcttgaagtatggaaccaaaagaccacaaacatatttatacagaactgattaaaatgaagaaaaataagagacgataaatctttatttggatgtatgactgatattttcaggtgaaaaaaggcgtgatctttgcaaactgtcatgtaccttgtagactgcaccgaagccaccttctccaagtttattctcttcagaaaagtttgctgttgcaactcttagcatagatatatcaagcaatagtgactcaacacttctgatctcttctgggttagtcccgtctactgaaagagcacattttgaaaaaccgttatcagaaatttatataaatatataaggataaatttcacccaatctggcagttgcaagaaacacgtccattagtgacacatcatgaaatctggtttgacaggtaattacgcccagtgaaattaagaataaagaagtgcatagtttattccttaaaagtaaatttatgatcatattttcaggttcgcactctccatcttactgcttttttattcccttaattgaaggccttactaaagctctcttaacagaaacttaagaaggccactgcatttttatgaaagcaacagcaagcatttgattcatggattacttacagggtaattttatttttgacctcctcctccagaagcaaatgcatataacagagatcagaaccagagcacatactagaggtatggcaattgcaagaaccatacctgttacgttcttcttgtttcctgcatggataaatgagcaatttaatatatattgcacaatctatgatgtcgaacatgaagccattagttgagtcacattacatcagggaaaatttacattgtgagtaatggatctttatgtcataatatgaaaactgagagatgtgggataacatatggaaattgagagaaacgggataacttttatcagtgttcactttaaaccacatctttgttatttaacttgagcaggaatcaaagtgtttcaagccaatggattcggtttgaggcaggactctgaattcttgaaagattgtcatataagaagaatctgattgcaattttttatcctctgaggcccgctttcagaaaatgatctacggaagtctgcaaatgtgaaacaattacgattgttggtgggaattgtgaactgtctttgatctgataaactggtggaagtttctctttgaaagagactgtagaaaattctcagaataaaccggtggaaggcctaaattttaataatggttctttggcttgttcgtggaaaatggcacttgtatatttcagcccttagtattaatccccagctacacagcctactaaaaaatggttatctttgttgtgttctgggacatccaacattgtatatctttatttttgatcgaccaagaattccatgtatctcaacatgagcctatcgtatcagagaaagatttaataaagttaaattccaaatttcataatatggaattttaatgaattcgactgctgattccatatgttctgtaggggcaacatcacaagtaaagtatgcttgctagatttagatgctattttttgaatttcgacattaataaagggccgcttcttagctatcttctcttggttgaaagatgagattgatgtgctagaccattggcaggtaatttcgatatttaggtctatttactgggatccatttttcagttttctgcatcataaatagacgagtccttcttctctctctctaaaaaaaaaaaatgaaacacctgtccagatgcatcccatagagtcggcaactcttgcaaatagattttagcccgctgaagaggaacatcctgcatatggtgggtttccaaaaaggcaatctggttgtcaatgtggtttaaattttggatattttttatgagcttgaactatgatccaatctaaaaagcccatgttgcgatgtgaataaaattttttgggaggtctatggtgatagcggagggcatgggccgatagggattttgtgagagaggtttaggaaatcaaattgcggctaaagtttggagagttttgagtgattatatttctcttttcatcataatgaaatttttctctcgtatcttgtccgtggatgtaggcttttcagtcgaaccacgtaaattctatatttgttttttcttttcttctctattttgtgtgattgtacgaatttatgtatgctctatttttgtgcttgctgtaacactggtaaatataattgattcacaattacttcacctaatattcattgatatatgagtgcatgtttaaactccctcaataaacttgagtgaatgtttgtgttcataaaaaaataaaataaaataaaattgtacccaagcaacttggtttcgctggttattaaaccgatttaaagaagattaaaaaattttgaacctccatgagtgcctatgaacttatgtaacaatcttacttcccttacctcctccactagcttctccagctgggggaacaagtggagacacgaaaggagccggcggtggcgcgttctcctgcggcgaagcaagccttagcgttgaggctccgttatagaaggtgtagagctcatatctaaaagtgcatctgggtccaagcacccgacccccttgcctcccagcgaaccacttgggtatgtagttgatgaggccctgcaggcatcgccggcactggctgcccggcatgtccggcgtgcactgcgctagcccgtatatcgtcggaaaagccttcgtgaagttcacctcgccggtggcgaaccgtcttgtcgagttgtacgcagcataatcggctatggcatcgatcagctcggtcagcagcttgtcgaacttgtcgcggtccgtcacgttctgggtgttccacatgaagacctgaccggagttgttgtaggacgagaggaaagactggttggagtagcggagcatgcaggggtcgtaccagatgatggcgcctttgttgtaagggcagagctggaggacgtctttggaggcagtgttgagacaggactggcactcggagatgttgacatcgccacggcagagggcgaggccatagatttggttgggcgcaaggccggtgctggcagtggcgaagccattggaagaggaggcgttggaggtgaggttggggaagaggaggttgaggttggatgcgtaagggctgttggcagtgtagttgccggtgccaccacagatttcgtagagagggtccgcagcagtgggagcacaatggaggaggaggaagacaagggataggaggaaaactggaaagggggaggggagaaaacgcaacatgatattaccgtttgcgcgggtttggagactccagacgggaggatctgaactcgcttgatatttattgaaaaacgtagaagcagcaatcgttcactcaggtcaatggaaattgtggtctttctggtgtcttaaaacactggtgttcgagaaatttttgtatagactttagtactttaatctaaaataaatgctatagattaaattaataaatataaaaataaaaataatattttagttgatggataattataagtcgagttataatttatcaattattttattaattttattaattattttattgatcacgatttcaactcaatttttaatcatccatcaattctggtctttatttttattagtttagcctacaatatttattgtaggtcaagcctatacaaaaaaattactcggctgacgtttttacggggaaattttatcctgcagctggtgtaccagctcagcagcacacccggtgtaccagctcatcggcatgctcgggtgtactggcccggtggtatctcggatcaatacgctgcaaggttaacctgaccatctcaactttaagagtagaaaaagaaacaagtgctccttttccgtgatgccctcccagcactccactgctatcccatcagcgctggcatttgtgagggccatgagcggtccccccatcatcttccgctaggctatctacgccatggcctcaacggcatccatggagcgtaacaattaaatattggatgcgctagccaacacaacagcagtagtagggcatggtggaactcatcgtcaccatcagagagggagaagtggctatcaagagatccattaacccaaaaggagggtttggaggagtggttattgggaggcagcacagcgacaatatggggaggggcggggcaaggcgcgatgaaaaggaggggtggcgatggacggaggcggtgacgcttgaggatggcggagcggcactgaggagagtggatttgaggatctgagatccggcttgccagaagagagaagggagcgacaacacgatccaatctgaaggagaggagggagatagaacaagtagggtggcaaagccgcggcggtcaaagcaggggtcagcaaaggagggatcggagtattgccagttcattgttactgatccatcacttgatgaccccgatggccccccgacttccatgctgtttctgcagcgatccaaagggctattttcattttctgagagcatttttttttaaatttgtcaggataaattttgatgacaatatcataaataataagggcggaggaggatttatcgtacggccctgaccgatgttagattgctggcaactcgaggttcacgtcttttgagcttccaattccgaaaattgtgcttcaggccatccagagaagcatcatttttgccggacaaaaattgcagatagaaaaaatttttgttgagaaaaattctgctactgttattaattggatctatttatgaagtaattaaaaatatatttatttttttataatatttaaatttttctgtattattttactataatattgatccgacatgtttatttgaagatgaatagtgttgggtatacccacagtcgaagtcctcagcagaatcggctacagacagactgcgtccggactcctacgggagccggactccgccaacaacgtcaaccgcaagcagactgcgtccggactactacgggagctggactccgccaacaactacaaccgcagacagactgcatccggactccgtccggactcctacggaagccggactccgccaacaactacaaccgcagacagactgcgtccggactcctacgggagccggactccgccaacaacttcaaccgcaagtagactccgtccggactcctacgggagccggaccccgtcctcaacatcaaccgccggtaagccccgtcctgcctcctacgggagccggacctctcctttgactttaataacaggagactccgcccggactcctacgggagccgggcttcgtcctcaactccaacagctacaagcagacttcgtccggactcctacgggagccggactccgccaacaacttcaaccgcaagtagactccgtccggactcctacgggagccggaccccgtcctcaacatcaaccgctggtaagccccgtccgacctcctacgggagccggacctctcttttgactttaattgcagggagactccgtccggactcctacgagagccgggcttcatcctcaactccaacagctacaagcagacttcgtccagactcctacgggagccggactccgccaacaacttcaaccgcaagtagactctgtccggactcctacgggagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaggagtccgggcggagtctttcttgcagccggagtcggaggagactcgcaagggttaatcccgctgagaacttcggctgagggtattttatacccaacaccagtccccctactttcgagtttgaatttcgaacgaagaaagtacagaaagatcatcgcagccgaagttctccccttgacgtccgcgcgtgaccgtcctcagatgtgctggcatttaatgcgcgcatgctggagcttttttttgattaggacgatccgaagagccttttcgaaactcccaccgggacgtgatcccaagcatagtgccatgaaagtttgcgaatggtcaaccccaggtcgcggcgagtgggatacgtggtgggcattggttggcctaggggcacctgccaccataattgcgccaggcttcgttgcctatttaaaccccccaccttttctccaggggctttactttgcctaagggacgacatctttctttcgcctttcgcctgagagcttagccactcaaccaccccatcggtgccccttccgactctgagcgtcctccgcgccggtctttgccgtctccagtcccccgattcttctctaagggattcccccgccagggcctccgcctcggaggccaacttcaagaggatgccagggacttggaagagtgcaaggaggagaacaacagtctgcaagttctccgattgtcgagctgccgctgagggttccggtcgctttaaagggggctcgaggaagaatttcttcaacaacagaggtttaataacggggataaccggtgaaggcattctgcctgagaatttcagagtagctggacggggcgacaccggtcaagagggcaaagctatcgtcacaagctgtggcgagatccttgatgtcgtcggggctgagggaccagaagcggtcatcgccgatggtggggcagtaaaatttgttacggggacggtggaagtagcgcatgccgaccttgccggaacacttaggacggtggttgtcatgaagcattcggtgatggcgcatatctccgacgccattgctgcctccggggtaactccgattcttcttgaaacaggtcatcgtcgccgctgccgttgcctttgctgccccttggaatctatcccatctttttccccctaaggttgggatttcggaggtggagcggaacgaggtggggggcgagagctgagaggcttgtcacacgaaccgaaaaatgcagcagggaaggacagaaacgggaagagcagcttgaagtggcctccggtgtatccctttcgagccgtgttttcgagccttataacaatgtattcttttctggccctccgggtcttgtaacatacatcttgttagtcgaaaaatgaggaggtgattttgttatctcatccgtatttgcgtcgaatcattgtccgccgagcttttttctttaccgttgttattattgtattcccttctccccccccttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcattgaattgttgttcgccgagcttcttttcaacctttgtgttgttcggaggtgtccgattgtcaacgtatcgacccatctttttcgcccgtggccgcaggttcgtctggggccgctcgggtttggtgtccccatcagggctcgagcatggaggtctgagctttcgtcaccttgaggaagtcatctcatcttgggtttgtgttgaaagattccgtgaaagtcggggttctctgcatcctagacgctatttgttttccattcgtcgcaggcgtagttcagcgcttttccttttagcttctctctcctttttcttttttgagtgggattttttcctccgctcttggtgggactgcaggagttcggctcccgtaggtgaagtcggggtgaggtctggctcccatgggagtccgaacggggtctacctgtaattgaagtcaggcagaatttggctcccgtgggagtccgggcggagcttaccagcgttcaaagtcgagaacgaagctcagctcctgtaggagtccagatgaagtttgcctacagccgaagttagagaaggagtccggctcccgtaagagtccggatggagtcttcttatgattagagtcgagggcgaagtccggctcccgcaggagttcggacggagttttatcacgaagggaccgctgggaaaggtatctctttttctcatctggtcttgaatgaccataccttaattgatgtcgaggcgaggttcttttcctatttctgtcgtaacaaggttcagctctggttagggcgaggttcgcctcttgtccctaacacggctgtaggggcacacatgggcgtcgctgggcctctctccccatccgatctaaagggaatcagaccttcgactttgctcaagttagggcgaggttctcctcctgtccctaacagggctgtgggggcgcatatgggcattgtagggcctctcctcccttccgatctaaagggaaccgggccttcgactttgctcaagttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttgaagttggggatggagtccggctcccgtaggagtccaggcggcgcttaccagcagttggagttgtggacggagcccgactcccgtaggagtccgggtggagtctttcttgcagcctgagtcggaggagactcgcaagggttaatcccgctgagaacttcggctgagggtattttatacccaacacatgccatatcaattaatatagattcgaaatatacattttacttgaaataaatttttcaatcatccaaaaattgatcttccactctcattctcctagtcctctaactatggcaatggtcgacccttgactagcctcgaaagagactagatcctgactacaatatactatccactgatcatgcaccaataatcatcctattgaaggtccagaagaaaaactagctttaatatcacatagaagaatatgctctcaccagcacatgccagcgattagtctcacttggctgggtccaaaagaaaaactagcatctcactgtaacataccatccatcagtgtgcatcaatgatcgtcctattagaggtccgaaggaaactagatcatgaatccgtataatcaaagttggactaaagagtagtgaaccagcacacaacacattttaatataaagaaatataatttatttttcactaaaatatgcatattcgatcgaatatttcatgaatcattttcatatagagcatatatgataattgatttaaacaaaatgctataacaatagaaaaatataaaaattaaactcatccatgataaaaatacattagggatagaaataacttacaaattcttatcttagatttttgtgatactttaccaactaggagtattaaccaaaacttaaaataattaaacattctatttagcttctcatagcatattctagtccaaacaattgaattggacctaaaatccaagggtcttgaccaacccttgaatccaataattatctaaacaagtatttcaatagattacatggttacctatatgtagaggaattggtcgcaatcactttttctcgatatctggatctgcatttccacctgaccaaatttaaatttaattctcaaattaaagaaaaattaacctaattaatgaagattaagcttgatctagatgaattgataaatatagaaatagagagagaataagtctggactaaattggtgcaaggatatgatcgtaatatcttatgcatagatcaaacatggagagagagaaataatattacataaattaattgattaaataactatccaatgaataacataggaaaaatagatgggaaagaaaagaaggtagagaatgggggggagggggggcgaggggagagaagaagaagaagagttgggctgggatggtgatggcatggtgagcatggctgggtctgttggaaatgacggtgccgatgtggcggcccaaaagaaggccaaaagaagtagaaaacatagttcaaaagggcttagaataatcaaaaagtagagtttggatctaggaagaatgaaagagggaagttttactcattggcgatcattggggatggtgggtcttggtctatggtagtagttttccgatggttcaagggcacaaaactgagctaaaaatatagtattggtggaatatagagagaggaggttttcgagcatttgggctttggttaaagtggcttgccagctattggagaggaggaagaggcttggtgatggctcaaccacaagtggaggggtttaaatcgaagatggccatggaaaggataagactagtctaacgttgaccattcgttggttgcaccagcccctaatagccatcggccatttacaccggcctaaagaatccacacctaccataattgggcggccttaatactaggtgatggggatcgagatctcccctatttcgattttatttttttttcaaaattacgaattaaagttagtaatgagtttgccaacttcaattcaaaactaatctagatgagccaggtttcacactaggacagtggtgagattgataaggatggaggcaccaacactatagtagcagatggatagaagcaaaggaggaagatgagggtgatgaagaccaactttgcaggaaggaggtagaagtggggtttaagttgtatctttcgaacaaaagaatctatgattttttttcgtaacctcaaccattagacacacgttacatacctttcaaagcatgacataagcttcgtgatctgtgctataaataaaagaaagagattcatcatgctttgaaagatgtgcaaaacacgatccaatagctgagattgtgaaagaagatcaatcattctttcaagcaaaagatacaacctaaatccgtgaaagagggaggggaggagagaggaagggttaggattttgagaggaggtaggggatgttggggctaggggaaggtggtgaaggaaggagggtgttatgcttagatggccacatggctgaaatatattggcttgatgtaccattgagctggtacatggggtgtaggatataatttctcattccaatagggatgaatggtagatcattgagcatccaaatttcttggcattgacctttttaattattctatttttaaaaacaaaaccacataaatcaattaaaaatatgtttgatgtaaatatttttaaatttatttttcaaaaattactttcattacgtctagaaatgtagaaaagagatacttacttttagtactttcaaaaaaaaaaactcatatttttccatcaccgtcactaagtccacctctctcaatactaatatggtctcaaccaccaatatagtcgcaacatctatcatttctaacaatatttatcaccatcatagtcatcatcgcctccaccatattgttgacaaccctatcaccaccattgccatgtcacaatagcatcacctcctccaccacatggccaacaccaatgccaccatcattaccactactgccccatcacaccaccatagttgccattattattgtcacctctattacatagcccgtgctatcaccactaccttcatcatgctaccaccattatcatcattgcttccaccacatttcagatatctttattaccaacatcgcaacaaccgttatcgccacttctactatatcatagcctctatcactcaatccgtcatctccattatcatcatcatatttagatttttaaaaataattgatcatatctaaacatttatatttttaaaatttagaagaagtgaaaataattttttattttttacttctgaaaatagagaaaatgaaagtgatgctagccaatacctggttatatatcctagattttggaatgtgaaaggaacgtatgtaagtataactaaaaaaataccctgcgggtaaaatatatctggatggtttgttttttaccattggtgccatcttgccttttttggctgggagaggaaactttaaacaaaaatagtgactttacccaaaaaaaacaaatatagtgtacttattatatatatcaaaaacctcgatttcaagaaatcaagctctcagaaagtgttttccattatatggagaagggggccacacctcattgcttggcaatgagaaatgccaagtccaattcctaaacaatacatccccagcagtcaggttgtagataattatagtgaggttgactcttctcctcctcagaaagtattattcacttcactgaattcctccctagtagccaatgatatttattcttccttatcaatgcttaggaaaaattttatatataattgattatcagaaatctgattgggtgactttcaaaatcaaacaaattaatctggcctctagcaccataaaaaaaaatgtttaatcaccaatatcaattcattgtaatagatatgattgtaaactaacaattatatgaatgaccataagttaattaaattctaattattattagcatttaatataataggtgtaacaacccataatctcatcctaaannnnnnnnnnnnnnnnnnnnctaaaaacaaaaaaaactagtcaaaatgtattaattaagttctttggtctgtataaatatttaaatttttttagtcaataattaatatagaattaaatatacgttcatacgaacttccttaatagaaggctttgaaattgatataattgtttaatctctgcataaacgaacccaatcggatcagctgcgtctcaatcatctggttttcattatttgtcgcaccaatcatgttaccttatcttatactgtgtcctcgtgttatctcttgtttagcacatcgaagcgcttgctgccagcttgcggaagaaaaggagactgaagtctttggaggagaaatttccagtcaacataggcgcaccaccgatattttctgataaacgacgcactacgtccaaactctggaacaaggactgggaccgctgaaaagacggatctagaaaaccaacagcaccgcagccaatggatcccagtggtctatatcagagaaaacaaacgagcccagtggtcccgcgtagaataatccatgaatgcttttgttgttttttttttttaccggcaacggaggatgcaaggcacttaccccaaatttattaataaaataaatgttgttcactgatggaaatgcagaaaaagcagatactgtcaggttgcaacatgattcaagaacggatgagcatcggtgaagggaggatggagatgagttttttgtggctatccatcaatttgtcggcgcatagactttcctaaaacttgaaggtgtgaaggattttgcaaataatccacgaattctgatatctagaatctcagactatgtctgaatgcagtggacgctggacggaagtggtttagctcaccatggtagcaactactaccataagcgaatggcgatgctgaagctcacattggtgatgcatattttttttatgtattctatctattttcatagcaccatgtataacaatctaggatctcatttaaaaaaattagtttgtaaatattattttatttttttaatatatataaatatctaaaatttacttaatatataattgatgtaaattaaatatatattgtatggattctcacgtgctccccatcctcccccaatttaaatttttgccgttacgtgttcaaattcattcagcttcaatcataaatatcataaattttaatcacaaagattatattccgtgcatgatctacccatagaaatcttcataataaatgtgtcggtagtgttggcgttggtcaggatgatggagttggtagaggtactagtgggattggagacaccgagggaggtgtagcaccagtattagtggtgatgcaaggaggtagcagcatggagagataggggatgtaaatctttctcatgttgccatcaattcatatcttgagcatccgcatgtcttaaaggatcatattagattgatccaacggccagtgctgcatcaacccatacaaattgtcagctgagttgtggacctaccgtgcacgtccctttgctggtcagatcactgcgtggtctagtccgctttctagacaactaagctgatggaatatatattaatataatgctgctcgatttaagtgacacaatagcataccaagcatgtattccccaagatattcttaattctatttcctcaaaaagtgaagtttttactacttgtatcctgaacagaagtaaacatttatatttttcgagattaaacagaagcgaacattcttaagacggaaagaaagcaataagtttaacttacaagagaatggaaagacgttaacatacaaattggtttcccaatgcttaaaaatattcgagcaacaatacaagtgttacatccatcgtgcaaagtcttcagtgtttcgaagaaatactaggttttcaagatattaatcaactaccttctccttgcattcttgtctccttgaaaaaggagaaaaaagggaaaagttatctcccttatcttcttaaatctatcttggttcaagttctgtgattgacatctcatttggtgacattggaatcggcctgctcaaattgtggtcatatgcgcctctactctttctagtgcataatgcaggtttggaaggagctttatgggacacagtgttgctgttgagcatcagaacaaccgtagacatgtttggcctatcagatggattatcctgaacacacaagagtccaatctgaatgcattttaaaacctcacttccttggcaatggtggcctaaagctgggtccaatatctccaaacttcttccttcgctccacttgtcccaggtctgcattgaatgaatttacttagtaaataatccagaatggaacaatgtcatgtatctattaatggttccttttgtggtgagggacggaaaaaagggaaattgcgctctatctacttgtagttaaagaaagaaaaaagctcacatagctcagaaggtcttcagagggatcactgttatttcttcctgttacaatctctaaaactagaacaccaaagctgtaaacatctgacttggtcgaaaaatgcccacgcatggcatactccggtgaaatatatccactgcaatgaaatgaatggagtttgaaaatttcccataatctatcattggaataggtggattattcaaaatttatacttacagtgttccgacaactttgctggtggtcccctctgtttggtcaccaccaaagagcctagccaaaccgaagtctgaaatttttgggttcatgtctgcacctaataggatgttgctggcttttaaatcccgatgtacgatttttagctgagagtcttcatgcaggtattgtagggcccgagcaattccttcaatgatcttgtaccttctcccccaacgtagacatttgctctttataggatctatttagacacagtggtgacagttaattactattgtagtatcaattgcaataagcctaatagaacttgaatgtagagatgaccagaaactcgttactttatgccacacaacaaagattccgtttgaaatgcaagtttccagagttaccagaaagaggacaggaagagactgtaatagcaagctgagcatactgtgttcacagtgcaaattctcataagagtaaaatgatatgtgtggaagaagtaccaaataaaaatgtgtccaagcttctgttgggcacatattcatagaccagcagcttctcttgttcttctaggcaaactcccaaaagtctcacaagatttctgtgctggagcttagcaagcaaagctagctcatttttcatttcttctagtccttgcctcgaactaattgtcaatctcttcactgctatttgtcgtccatcaggtaatattcccttatcaagacaaaataaatacaactgaaattgatttggaattttggatcataagaaaaatgaagatcaggtagaacaaatgttcgttttgaagaatttaagagtaaattggaaaaacagcatatgctcttcacttagtagactaccatgatacctggtacactgtaccgaagccaccttgtccaagttcattcacatcagagaagtttgctgttgcaactcgtagtattgataggtcaatcaacagtgacttcacacttgtgatctcctccgggatagactcatctattgaaagagaacaaaatttaattaatggattccctgcggaacattagcaaaaggatgacaagatgaactcgattggaagaataattcttttagcatttttatttcattgactctgcctgtacatcaaagagcacaaaatttaattaatggattccctgctgaacattagcaaaggatgacaagatgaacgattggaagaataattcctttagtattttcatttcattgactctgcccgtacattaagatgggaacatagattattcctcttcccagaggtgactagtggaccaattgatgtaccttaacaggccaattaaaatcaataatcaaataatgcatgatgcagttaagatctgacatatagggggtgtttggttggagggagtgggggtctggaatcgaaatcggaatgagtgactcccattccaatcgtttaattgggaagagtcccattccgattccgaggtggaatgggaatggatcaatctatatagaactcaatccctactctcctctatggattcaatttttcatttcaatttcggtcacgaaccaaacgcttcgggggatttggccattccaatttcgattccaagccattttgattccgattatgaaccaaacgcctccataatgttcatacccaaaaacgacatgatatatgatgtcaactccctcactaattactaaagctttggggtatctagtggttacttaacaagtgttcacagcttgagttcatggcttcttaatttagctatttttcttttgtctttcttgacttgttgccttcaatcatttatgactcgtttatgtcttcgtatgtataatctgcataacttaaacttttagagtcttggcaataaaactgtaataatctaggacctcaaccaaaaagactagtcagaagatgttatttgatttttttggccctgtataaataatcagaatctttccagcgaataactgatgtaggactaaatacatatccatattgattctcataaaaataattgcagtttaagcttttagaatgtagtagcgataactttaaatttgttctcaataaatttatgcctccattgttgttaacatcacctaggattttttttttctttagaaaagtctaagatttcattttatgacctttttcttgaaaaccctagaagacgtggatcttattatagctttagccaaaagtttttctttaggagaacctatgttatttgtcctttttatttttgactcattcctagttattacttgagttttcttgactagctatctttagttgtttgtgacttgattatatcttcatgtgcatgctccgggcagcttaagctttcccagtccggtggattagttaaaaattatagcttaagcttttgcattctagtggtaagttaacaacagctccaagtaaatatatagtcatacctcgatagtcaataatgtcaactaagataatcttctttcttaagaaaacctagaatttctgcttatgaccctttttttgaaaagcccaacacacctagacctctgctttaattttgtttgtggggggtgtaacatagacctctttaaagctctagccatgatataaatggaagggctggattttttgaagtaacagttgaagcatttagttcatgggttacttacctggtaattttatttttgatttcctcctcctccagaagcaaatacagatggtgcagataagcatgaatgcaatcactagaggcatgatgattggaagaacaaaacctgtcatactcttcttgttccctgcatccataaattaccatcttcatttgattttcatgtcgacatgatgcatctatgatatcaaaacatgacctgattcatttaagacaaatatattgcatgaaagcatttttattgcattatgagtccattagtaccatatggacatggaaattgacattagtggagaacttcaaattgaagatctgtcgtattccgggcagaactagagaggtccggtcctacaatcatgactgtcaattgcacagatccaattctatgatcagaaccattcatatattgcataacgatgataccgtaggaacaatgttgaagaaaaaaagaataataaattctgtaaggtatttttgaagatactatattttgttttctttttctttcctcgggaagggaaaaaaaaagaacgaaatgttttgttttagttctccaaaaaattgcttcttgtgtttctttaaaaagcaaaatattggttgtaagattttatctttttcagtgttataaaaaatatatatattctttttagttataataaacagaaacacatggcggtcactaaaaggttaagtggagggctccatccttgatctcctcgagtccaggctttctttggtctttaaccaaggcagctccgcttcgcgcatgccagatgctcgacgaaacgccagcgcgagaggcacgaactcagggggcacttatatgatcaaagggtaaactcgagcacagcgttaggagtaatagttataggtattggtagaggtgccgaacggaatcttcatttgtcgtacagatgttgtgagaagaaagatgccgaatcatggctgttagggtacgactaggttgggccgtggctcataaagggaaattgcaaacggctaccatgcatgctgttgttctcacaacagtaagaagtgcagagttaccaaactggttagatatactagcaatactgatgttgtttcccttaccttcttctctatctggggtatgtggcgcagctggtgccgttgcgttcaccaactgcgatgcaagccttagaatcgatgcttcctggtagaacttggatacattatacctcaaatagcacctcaccccgagcattgtgcccccccgttccccctcgaaccacgacgggatctggccgaagaaccactggaggcactgctggcactggaaccctttcaagtcccaagtgcactgcgccagcccatatatcttcggaaaggccgtcgtgaagttcacctctccagtggcaaacttccttgtcgagttgaatgccgcccagtcggttacagctttcacaagcttctgcaccagctcgtcaaacaggtcgccgtccggtatgccatcgacgcccttcaggaagagctgcggattgttgtcggtcatcgagaggaagtcctggttggcgtagcgaaggcggcagagatcgtaccagatgacggcggctttgtagttgggacaaagccggaggatgtcgacggaggcggtgttcaggcaggagcggcatgaggaggtgttgacatcgccacggcatagggcgagaccaaagatttggtcagggctctgaccgatggtggcattcgaatagccacctgcaaggaaggtacgggtggtgaggttggagaggaggaggcggaggttgaaatcataggtgttgttggtggtatagttgccagtggtgccgcaatctgggtagaggagatcggcggcggtaggaggggcaaggaagaggagaagggacaggaggaagagaggagaggaggagaggagagatgaaaacatggcggtatttgatactatggctgtggtgagtttggagactcgttgtgtaaggtcggagagagagttattgcgtccgaactgcagaaagtaaatggcattccacggaaggcaccctggagtggggcgttcaattgcaaggctaggaggatgggggtagccggaagatggacggctgttaggttgtccatttcataatggggaccaccaatacaactggtgcacgggaaagtagaccgtaatccggtgtgccagctcggtggtacattgttactgtaaaatggatgtttttttcggttcattttacagtagtaagaatccatagtttatgataacttgggactagtgtaattatgatacaaaattggagataacagaacttaaacatgcttgatttctagagtttttaaatcaagttgtctgtgttaaatcttaacttgtcactttggcttctattctctcctttttagttctcccgcatccgttctgagaggctatccatgtatgaggcaggagcttggattctctccaatccatcgtggaacttgatatgtctagcttgcactcacagactattgtttatcataagataaccctggattggttaaggtctatatgttacataaagctaacacacaaagccacatgccaaatcacaggccatcgtttgatgcacaaatggcttggactgggcctctctaattcaatcggcagatagagagtatcccgactgagacatgccacttttcggtctcgctctggcaagaacagggcagtccttggggtcatgcattgctgatacgtcaaacaatattaaaaaattattaaaaaaaaaaagaaaagaaagaaagaaagaaagaagagagagagaaagagagatcagttcctataggatctcgcaccgctcttccaaaagcaccagccatccctcaccccaagggtgggaaggtagccttgaaaattcaaagatctctaatgactacaggatcccagatataagccgtcaacatagacccatacaacacccttataaagaaattattgcctccattgcatacatcatgtgattgtgtgcacagctaataacgacaatcagcttttatgagcttcatgtatggagcacgcatcttgatctatcgtcataagaatcaatgataatgattgggtgcgtgcataactatattaatgtgaagaaaattcagtgcaggggtaaaatgataattttaaaaatttttcaaaatcattattttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatctttctcggatcagattcttccatacataagcatgtgggggctgtcccaagcataagctcctggcaggctattctacatgacaaggtcagtccaaaccatatttctctttcttttcattttcatgaaattataatatttgactttattaatcaattcaaattttgcagtataataaatatatcatacccatataatcatgccatcaatcactgatacatatgtattgatataacatactcatgctcaaaatcgcataaataaatagcagtgtctcagatataacaaattcatcgatctcaaatccaacgatataaaatcaataagataaaaccaacggtaaaataacatatataatgatgatcatgtacagaaattcttacctttatcggtgactgattcaagcacagaaatcaatgttcttctttgatttataaatttttttaacaaaatatttcattcgatatcatatgcaaacaatcatctcttcataatcttaatcaaatataaaaatcatatatggagaaaattatccgataatcaatcctaataacacaaatctaggacctctctcaggattaaccaaaattaggatttgtctaagtatctagatcttccactgattcataaaacttttagagagagaaagtccatgaagagagagaaaattttagagagagaaaataaagagagaaaatttttgtatccttcaaacgaggcaatcatgatcgagatcatcaaagatcatatcaggatgactcaatatggattaaccatgattgatgttatcaactttgaataaagatcagatcgaaatctaatctactgcatgaattttggagcaatctcagatcatcatattttcatatcaattttatcctaggattcgtgatgaaatcagagagagaaagatactagagagataaaatccataaagaaagagaaaggtctagagaaagaaaatgtagagagagaatgtagagagaagagagagaaaagagagagaaaagagggagacgagagagaaaatttctctctcttttttctatttttatttttctctttctcttttttttctctcttttttttctttttcttttccttcnnnnnnnnnnnnnnnnnnnntttttccttctttcttcttctttcttcttctttcttttttccttttcttcccacggcctcccttgggccgaaacaggggacagacgagggctccagcttggctccgacaagggcgacggcttcgtcagaggtccgacagcaggtggaggcggcggtggagcaaaggatggccggcgatgaggttcgaccagtaggagatttaaaagacttgaaaaataggggatccgccccttttcttttatttttcgatcattgatcggtcaccagcggccaagaccttcaaggaagagggataaagggatgagggtcctatcctacggatgagacgccacaaatgacgatgtcggtggccgaaaaagagaggaagatggattgttcgaacagagcaaaacatgggttcaccttgttcatggatttttcgacgatcccaacgaccggtgagggtctaaagccatggagagaaaggaaagaggaagaggaagaaaatttagagccttacctgagctccggtggcctcttcgaccttcaattttcgatgaacatgagaagagactgccgcggcttccacggagaaaaagagaggaatcgggctcaacggtcgctgatggaggctcgtgagggagaggggagttttatttatagagggtcctagagttttaaggatcccagaactcttctccgttcgagattcatcggagaagaagactcccatcgggagtcctctttccgttctgttttttttttgtatgggctttgggtttttgggcttgatccagggtccaaatgggccggagtgttacattaacttataatttaatttaaatagttaattaatttatataaatatttagttaaaatagtgaatataaataaaaagttgaagacaaatctaattatttacttgtgattatggaaatcatgtactaaaataaaattaattagtgacaaaatttattataaattacaaaaatctttcaagattaggtcaaaattataattacatctaatagttttcaaaacctaaatttacatccttcacgttttattcaactctacagtataacacatgtcgttagatagtccgttaatattaatttggatctaattgtcatatcataataaattttttaaataaccaaaataaccttgaacaaaggataagaaaagattgtcgccaacctgttggacatagataaccctaactggcatgtcgatgtcccattggataaagccccatattgggacccacacaaaccatgacctcagccctagcatagcagttcgtcgggtcgagggggagtatggtggtggagccgatggagggaagttgtggggcccattgtcgaggaagagatactcgagaaggatgtcattggagtccgaatcatagaggatgaagccggcattagcaaagatgaaaaagtggccgttgaggaggaggtggacaaaggggtagaggttgtccatatgggggtcttaagctgcggtgagaaaaggaaaggagcggaggagatggtccgacagatagaactcgatggaggaggtggcacagccaccaacgatgacgacagaaccatggggaggatctgatgggtcgcataccaacggccaatagtgaggagggatgaggggagctcaagggctgcagtcgttgggagagcaaagagagatggtgtggagcttgcagaagccatcaaggtcgtcaccactctgaaggagggtgccattggggagaaacttgctcgaggagtaccaggtgtcaatgaggatggagaggggttggtgtcgatgagtggcaagggtaagagtggagtgggcagcacaatcaccactggggagggcgcagtcggtggggtcacgatggcattaaggtgggctctcgaagacctagagatagtgggtgtgtcccataggcggtgggcatcctagaggcaagcataggccctcttcactgctaaacaacgccgaacaccttgcccaccaggttctccatcttggtcaccctctccaagactccactaggaccaactcccttctcttcctcccacatcttgagctcattctcctcttcctccacctcttcttcttccttctttcccatcccattgtagggcgcagttggtggggttgccatcgaggagagaatggtaggatattgtataggaggtagaatggtaattttgactttttatatattataaacatcgctaatgcaactaggcataagtgtagatttttcaaactattaggtataagtgtaataagcataggccttaatgggatttttataatttattctaaaatttaataaatataaggttaacagaataaataaaataacatatataaataaaatgaatgaaaaagaaaagtagtattaggattatatcaaaaaattaatggttggataattttgtcatcataaaaactcactcctcatatactccatccatcattctttgcatccttccaattttggaggatacaaattgatggactagaatagatagacgatcccttatttttaatatcgatctttcatgagatactttgaacaactgatagatgaggactatccattcttccaatctcgcccatcctctcttatgaacacaaccaaacatttagtaaaactgacaaatgcttgaacaccagatgaagcaaccccatgtatgcctgtctccatcggcttgacctagcatggcaatttgtttgccggtaaacgctaaacgcatcagcatattgcagagaggaaagccaagctagtgtcgatcggaaggatgatggagcagcacgcacttgtggttattctcaaaatatactgttccttcgagtttcctatcgtgaaagtcatgaaccttactttctagcatcaaggagtcaagtgaaatggcatgttatgtttgtatccagaagagaaacggagagccaaagtaacaacatccacaaatgtgcatgatggtccataggggctcggtgagtccaaatgcccttggaccacttattatgagagacatgttagatagaatgccttccaaaaggcggaatattcgtagattaggtctgcaaaaaatcgctgccaagtggatcccacctgatggctgatgcctaggatgcttccatgtacgctaccgggatgtcatatccgttattagagagaccgtagacaaactctctctcccttattcttcttcttttaaacggatgttcacgctactttcgtgtgagtacagcgtaagaggttaaagtacaaaatatcagatagaattttaagacactcctaattttaatatcaggatcattcactagaatgatcgataataaaagatacaacataatttgtgacgctactcatctttcgatagacatgccaaacagtcatcacagagaagtatcgaagagatttcgggatgtcatgaatcaatgagtgaattgtgaatgactccacaacatctcagatccagacaatagcagtagcagagtcaccctccacaacgatcctctcaacacgcatcttcagttatgcgtaggtgatacccatccaaacggcgcgacgctccgtgccaaaaactaatggcttaaatagaggggaccctccagctgctagcagcctaccctcagagctctggatcacatagcccgcaccacctctatccctcctgacactaccatcaaagggatcttgacgaagttcgaaagtgggggctctcaggagattaaaagcaccttacgaatcattgcaagagcagcactcttttatctctttctctcacagagtaggactattaatagggtgggccggacttgagattggcgggccacccaatgggatgatgggtttgaggctggaccttgaatattaggtcctcgttacttctgggccttaaatgggttggcccaagcttagaccaccatagcaatttgaagcttcccctctccattttatccccacgagtagggttgaaatcagatcggatacagatcagaaactagtgtatctatatccatatttgttttgtctatcaagtgtaaatatagatacggatattatttggatgcttaaatttatattcatatttcttttaaatagatatggatataattcagatattagaagtatgaatataattacgaatataacttaaataataaaattttatggctacaaaatcaaagatattactaaatagattataaatcaagttaacaatatgtttatatggttatatatattttttaaaaataattagtattatataaaattatgtaggattacatataaatttgaatatttggatacagatcggatagttgtctatctatatcaatatctatttttctttgataaatatggatgcagatacggatattagttggatcatcaaatttttatctattagatacgaaaatggatctaacagataatattcatatcactttgacccctgctcgagcattcaccagccatccccctcgggcctgtcactaccaagtcaccaacaacttctaccattgccattgggtactgttgctgctttcatcccattggagagatgaatggcgacaagtgactgagggtaagagcggtgagcgatgagtgggtgagaagaggagcagaggagaggaggtgcgtgaaggcagtagaggagaagattggtggccgtaggtagcagagaacgagatcggtgggcggtcgaagagaggacctgccgccgtttacagccgatcggttgttgttttttatttcacgtgaaaaatcaagatttgacaccagtaggaggtcgaagaagggatgggcctggttcttgctgttttggggcggaccaaagttacctgtcaaattgaaacgtgaaacgctgtctgaacttgcgggtccttcttttatttatttatttattttgttgggctgttgatgggctggcccaagctggatcgccagtagccttagcatcacctccacttttcagttaccacttttcatgaaaactattgttttcctttttttagtgaaatccgaaattgaaaaccgttagccttcctctgtttctattccgcccccccaccaccaatcatggcatacccatcatatgactttatccaaaaaaactctctttttatcctggttcatcattgaaaatgcaattgcgggttagtttgagtggtaatgatttttcttggagaaaagtatatagtcactgatgtttaatgcatgactcttccttgaataagtaatcatataatttttcaataattaaagtacgatggaatactatggaggattattcaaccatggaatattctgagtttttaaaggaattttctgtaattttaggtgagagtttcccataaattctttcaaagaagaaaaaaataaagaaattgagtacttcttttgaacagaaatacttcaaggattttttttatttaaaaaaaaaaaatcagacgccaaccaactaagctaagaccggttggctgatactttaattgaatattggtaccatggtcttagtggataccatatgaacaatcgggtttagccagtttataaataaaaaaacggtgagcttatgagtatctggcggaaaatttttgttaagtaaactttacctttttctactttctctttttgtattataaattattttcaaatttcaggttcacagaatcacatcaacatgacccatgacattaggctattgtctaagtgcagcatatttgggctggaatgactccactgagttcacgttgctagcttctcttgcaaggttgttaggagtccaaccataccttctgggacaagaaatgtgcccatatccaccctctctttttccaatgaattaactaatatatatggaccaagcacagagaatattatagcgtagaccaagaccctggaattgagcagaaggttataaagcataaagacgtcttcaagtcccttacttttcttcttttgagcccaatcttcctatgaaagaaagacaatcttcctatgaaagaaagaagaacagcatcttcttaaaaggttaatctttgccccaaagtcatcatccgagtctatatatatagaagctagcatcgcataacaaaagcaaccactacttactggatacagagagaccatcaaggggaagtgacaacatgactagcaccttgccagatcctattcttcaatccttccagtctctttggatctctgccacaaacatcgactttggcccagaattgtcaagcagcagaactccagaagaatttgtggcgtccgtcaaccatgttcttcaaaaccataaaggcaaaaagctcaataggttccgtctcttcttctgcccactcgatatgtttctacctgatattgagaactggatagcatttgcagtggcaaagggagttgaagaactagagctggacttatccatgggatctgaccccttgactggtgaattaaccaatggtggtcacccccttaaattgccagattgtctttttaaatgcaaatcgcttaccaatctaagtttgagccactgtgacttctgtccacctccggatttcagtggttttaatggcctccagtcactgtccctttcatatgtaagcattgctgatgatatgctccatttcatggtagccaattgccctctcctggacagcttgagtctcaaaagctgccagaatctcaactcgatcaaggtctcaggtgaagacatccaaattcagaggttaactgtgatacaatgctgggatgcatgggaaatggaggtccgcgctcccaggcttcgatctttcatttactatggggaacatatctttggagattcatcccttaacatcccatctctggaggacgccttcatcagttcaatcgatatggaaagaacagaacctgaacatgactacataaagttgttatttgatctctcacacgtcaagattcttactgtttgcacagcaacactaatggtaattttcttatgaacctaatttttattttgtttggtgatgaacctaattttattttgataaggttctagtgttatttgatgttgaatcttcattagttgtgtgttccaacagcatttcaccacaaacaaagaaatattagttgctttcattctctgatttgatgttgattctatattggttctctcttccaacagcgtttcaccatatatgaagaatttctacccgaagacctccctgtccttttaccaaacctacgagagttgcagctgctgatagatttgttcaggagcgaagagcttgcgtacatctatggatttttccggctatgccaaactccgttcattgagaaactcttcattcaagtaagttccctcttagcattgtacagttaccatcttacagtcctcaccatcttattcatctttgcagctccccaaaggacctgaagatccacaagagataagatctgtgccggagccatcagatattacttttaaccatctcaaggcaatcaaactaagcaactttaaagggggtatgagtgaaatgagattggtgagatttctactggagagggctgttgttctagagaccatggtattagtcgcccctccaaaggctgatctgaaggaaagcatcaatcatgagcaatataattcagcatcagaagccatatctcaagacaacgtagacttgatggttctacgtgggcagctgtcattgctgccaaagacatctagagccaatatagtgttatgtgagtatttggaggatgataaggctttagctccaaagcatacagaatactttacagacttttagcaattgagaggagttctgaatatatgttagttgttactgaatgcatcataagctatcaaatagcatgtctgaagtatgttctactcattatatctaagtggataactatgtgtaaaagcagtatgctaaatgttttcatcgtgatagcaaataaaatgatcttatatattcaagtgaagaatcaaattttatgaactgataattgtaatctaagttcataatttcattaatttgagtctaaaaaactcaagggtacttgagaaagctcctcatctgtaagtatccagatctcggcactgtgtgatagaaatcctatgttactaggatgtgcaacatagacggccttccagcattattctgcatttcggcattccaagtataaatgtctgaaaaggaaaggactttggtgctaattttctcaagtaacgtttgaactagtcccggcacgcgccgtgacgagaccaattcaagtactgctcaataaataattatatgtaagtccttatgttaaatgatatttcagtccatctcactgacttttcctttcacttctggtcatcttggacgaatatttgaactgatctcagcaagcagcttgccgggagtagttcaaacctcaaatagaacccaaaatagaaattaatacaaatcctcttttttagttacgattatagttaggtccctcgcccctcaccgcagctcgtccttgtactcccgcgacggcgacggcgaccgcgacggcgatggcgatggcgacggcgacggtggcgacattgttgttttccctgctctacccaaacccagagagcccgaacccgacgccggatgcctccgcgccacggtgcggcatcccctccgtctcatccaacgacgggacgtccgatgtttgtcttctcccacatatcttatcctctctttttttatggctaaaatggtggtgaacttgtgggagtaatgtgttggggttggaattggttataaatcttccctctttgatatctgagataagtgctagggtttagggttcgagctgggtgctatcttgtgacctctgcttccttctagctgttgtcataggtcatattagttcgtagatcaatagtggtttatgttgtgagttttggttccttcttctcctcttcccagctaatctttttttttgagggaacggctaatcttaattttagttcatcgctgttaccattaatttttatctaaagtcatgatctttgcttaagaaccattgtaatccagttgagacaggagaaacccttgctaaaatctggatcttggagacatgcatcaaaattttacaattttgcacattatggtgaaagagggcataatcgaaggaacaaaaattccagctgtttaattatagatggtttcgcaagagaatagatgagagtgtgattagtacaagaacaattcagaagatggaattattgcttttctgaagaaatggttgtggaaattcagatgaggctttaaagactctggagaatgattatccccatgtaatgctacaaaaacggaagacattaaaccgtttctgttgagttccttagagatctaatcatttgaccacttactggctttctaatctgacctctaatacacaattgtttgcactgaattccaaactggtaggttgtgctatcagcaccaatatatcttatgcccaaggccttttcctgatgcttatttcaaaacgtaacttggagatcaaaagtagttcacgtagaagtatctgtctgagagcatttgattttttgatatgcttcaatgttttaacaaacaattctgtattagttgagaacttgtggttgctaattttgaattctatatgaagaggctggtgcgaaatatctacaagtttcaatgccaaaccttaaggaattgcagctccttatgaactctgagcagttgaagatcttgcatgcatgcatggcttctttcatctctgtccttccccatttcttgagaagctctttattcaagtccgtctccttgcactatgtgatcttgtgtcattggtcattgtcatctgattcctgttttcttttaaagtcttccttcaaccatatcatttgttttgcagcttccattagtactgagatcccaattagatatgatagaggatgtgcaagagccattagatttggctttttaccaactcaaggtgatcaacatgagccattttaaagagtcaaaagggagatgatattgtttagatttttctagaaaaggatggtgccatagagtccatgatattagtcacacctccaaaacttggtcagaaggaaatcatcaatgaggaactgagtgtattagtttcagatttcataactctgcatgtccaactgtcatcgataccaaaagcatctcttttagccaacacagtcgtatgagtagctggataacagataagatttttggtccagcacatacattatattactctgaggtttagcaaattgtatatagaataatgccatatatcccaatttctatttaggggctgtctaataggttctctatgcttgggcatctgttttcttgtgttctgtatttgtctgatttcataaatgaatgaaacaatgatttacaaagcaatgttttaagttttacagtctgttgtgaaaataatgttagaaatttgtggctctcacttgatgcacttgataagaaacttatcttatatatctgaaattgtattagttcgacaagttttacaaggattactgcctggtgacataattggacttcctgaaaaaaggaccaagcttttgtacttgacagcgagtcttaaactcagcaatttactttgggggttgttaaggcaaaattttcagacttcagaatactagtcagcaaatgctaggtaaactgcatcctaccaaatacttgagcaactgaaaataaacaagcacaacctattggagcttatcccaaagttaagtaaatatttttgtttgatatttaataaataagatttaggaaataagaaatgccactgccatatgatattgtttttgtttaaaagatttacattctaagtagaaattctgagcttcttttataatacattgggttcatcaatgaaatgataataacataattttattgattttttgaacgttcttgtttggaaaatatgattgcatccattgatgtacaggttcgtccaagaaaaactaaatctgtccttgagcaaaaacagaaggatgtaagaagttgcttcagtgctgaatcatcacaaagctaggacctcctactcctctatataaatcttccataatctcactccatgacctcaagccttcttgatatcttttgtctttcttgtatccatatttcagcttttcaccatggtcgtttccttcctgtcattgtattgattggcgctccctttctctcacatatccatcttattatgctctgatattgcaacctctaatgaacttgtctgaaaaattcaaatacttcgtccagagaggccggagttgaggaaatgctatatccaaccaaggtttagctctgccattgaagtggatgaccgctgccttttctacatctgctatggtggtgttttcttggtatccaagccccaacatgtgccaatagggatcaatgatatgaacatggccatgaaatgctattaaaccaggcggtagagttcctaactgccatagacttaagtctgactttaagttctaaaagagagaaagagagattaattagagataaagatgcagctaggaaaagaaaattttgaagaagaagctgcttataagctgtaattaccttttgaagccagtggtggtaagttagactaatgtttgtcttcctccatgcgtcaaggtcgaagatattcatgccatatgcccaagcacactcattaggatcaaaacttttggaaattaaagggtgggagaagtttaagtagttcttgaatttctttgacatcacaaacttatcggctcctctgcatgtttcaactgcaccatttactttgccttgcagatctatgtcccaaagaggggaaagatcagcttggatgacaacatcatcatcgagaaagacaaccttattgaggctcggaaacaactgcaatgttcaagaaaacatctaatatttacacatcataaatcaaagaagtggaaccatcaaattgcaaatcatatttttataaaaacttctatgtgattagtcatcctcattttaattataaggatgtgataactgacttttggtataaattttatccaaaaccagtttggaagaggataggctgtgtatgggaacaaacattaatcaactcttaaccatcaaactatgatctaataacccatgttctttaacagatgcttggggtccccttggcaaaagggagcacgttccatgtaaaacataaaattttttttccaacaggtttatcgtgtgatttttgtttaaggttgactgtgtcataggtgtcacatccaaagctttacatccaattgggaaagtgatttactttgcttaacttcccttaccaattttaattttgtttttaagtaaaatgatggtaagaccaccagcccttccaccaaacgatgaaatattaccaatagaaggaataagaaagttgacctactacaactttcggaccaacaattcgaacaccaccaaagatattcttaggccctgaacacttgtatatgcctaatcagtaggcaagatctcattatctggatattactatgcaaagcgaaactactttgtattcagaagcctcatttctaaccattttttgatgcggaattctcaagcatgctttgatgttgaaagaataatctctgagatttgacattgtttaggtcctgaagcccatgacttctgtacattgttgtcataattaggacccatgggctaaattggccctcttccatctaagacgggctacggtttttgtttggccctatccagtcctaaatcacttttaactcatgaggtttgcaaccaagtgctggaagtatgtaagtaaaacttgctgcttcttactgacctcgggcaaatggatgcgaatatggttcatgaccgactgatactttggactcaaagcctgcagcttggccgccaccacgacaggtttctcgctcgcatcggcgatgatcgccgatgagcctcctcggaactgcgaccgtgccgccctgtccttctccatggcctccatcacggggaccctccccctcgtgaaccactcaaaatggtgcagccccttcacctcgatgaccgccggttccaatgggtgcagcgaaaaccaagcctgcatgggcgcgtacgtcttgcggtcggtgatgacgtggagcacgatcgagctcggttggagagaattggcgacgagggacgcggccacgacggcagcggcgagaacgttgtcggaggcgaggacgaagtggtggagggatgggtcgacaagtgccgggacccgcgccggggccgggagctggaggcgggcgccggaattggtggagtgctcctgggccagcctcagggccaggcagtggagctgcttgggaatgctggcggatgccacgtggcggtagagatactcctggatcttggccgtcctcgtcctccgttctagtagcgatatctgcagtgcccaacggtcaacattattatttttttcctatatttttgaattaagcgttaggtttgggttgggttggaaccatggctttgagccttaaggcaaaggttttggcatccgatatgttgttcttcatctctgcaacgaagtcttctagtgtttgtggaatatcagatcctggctcaggttcctcaatctctccttcttcgagtacacgatatatttcttcgggaaccttctgcgacaattaatagctttttttgagttttcatgttaaaagaagctagtctgctcagcgaaaaaagaaaaaaataaaaaaaaagcttatcttaagagagtaaattttgatgcctaagttttgatgattggttaccgttgattcgagccttcttccccaaattcttggccctagctttttccctacacatcctgacatccaaagcaaacaaataaaacacgttagatggccacttgacatgagacaaagataggatagaatattgtcttttaaaaaagaaaataaagagattaaatcttattcttggtaaagaatggagaattttttttctaaaatatgtgattatctagtttagcaaggaaaatgtagcctcaaacttttaaaaagtgtcaatttaattggttgcaaggggaaaagaacctgtctattaaccaaacttacattatgagttatacctaactagcagtgcagcacatgaggtctcttctggtccaagatacaaaaaaaaaaacagaaaaagagaaatgctgataagctaccccatttgtggtatttttttttttttttttttttgagaattcgcttgcggaattattttgaacgccaatgtttttaggtactcaccaaactgagataaagaccttaaacctgaaataactttatgcacatttaagcattagctttgctaacgactgttggatctgtgttgattcaaaaagattttcaaatcttatgccattcgattcatctcgtgacaggcccgcagacttcaatagtcaattttttggtgatcaccaaataatttatatcacaggttaaatgtttgcttaaactttggacatgacgatccgctatcgctgtcttaggcaaggctgttgcaccagttaaaagtgcaaggtaacgggatacaaaatcatgatattatcatccctaaccccttcaagtaggcattttatttcacatcaattttgttcactttcttttccttttgggattagaccaaccatgtaggaagtcagtcagcaagctattaaagggatttcatcaaatagtcttgagtctagataaaatctccattttttcttttaagatttctaattaactgattttgggaacatgtactgcatattcattgatcaggtcaagactatggaaggaaaatttgattattacaatcattgttactgttggtagaaagaggcatgacgtacgccaaaaaataaagataaaaaaagggccataattgaagcgcaaaggggtacggaatggaagttagcctccttcaaatccaataaatcttccatagaccatggacatatcaggattcaccaccacatattttttgatacaactactcgagtgcaccttcttaaaagcatatctaattgacggttttagtttctagccactggctcaattcttatcagtcatgtaaagagatcaaaacttattctaaatcttgggaattatatatttatttcagtatttattaagtgggattatgtatgtaatcttgaactagttcaaagtttatacgcaaaaatgtcacttttggttaaataacatagagggtttcaatgtattcaaagtttatatttctcaaaaaaaaaaaagatgcatcccaaagtttatcaagagttcatgtgcaagaagcctactgcaggttcaatcgcatggacttgttccatgtaacacaaatagttttttactacaagtataaatacagtaactcagaatttcactcaaaaaattaaattggggaatgtaggttggcaaactcgtcatggaaaccttgatctctctttgaaaacttgatgcatgcacatataattcatagaaaaaagaattcacgaggagcccatacctaaagaagagcactcggtctctccctcgattgtatctatcgccgtcaacacgaacacaaatcggagcaagaatgtgacaaagagcagcgagtagaacaccaccttataagaaagcttcctcgacgtgaccttaactttgatgaaatccctcacccctttccctgggaacactgtgacatgtctcatacttggcgatatctgaagctgcattgcaactccaaagtagggagcacgaggaggccaaaaccaatcaccctgactcagagtctccacagaggacctggattcccttgcagagacccataaggtagaagaagaggggatggctccggagattgtaaaaggagccctgctctggtgccgaggttgctgtccaccacctaacttacctttgcacttgggctaatgcttgtgttgttggagggaacagaggtaagggggattcggaggggggttgtttgagaaagagactcaagattcaggtactctggagagtggtttggtgagaaatttttcttagaaaacttcggatcttctgatgagcaatctgttagttcttctcagtcttttgccataattttcagatataggagagaggcatatgttaataaaattagaatagatgggaagctgctgtctgcgttttgaaatgtaagtttgagttggttcctttgccttcaaataaagtagaggaaaagtgaccaaagagcacccctcaacaaagacagggacaccccaacgagaaggtactagtttttttgtccaacccggtccgttcacctctagactctagactggacctaatgggggcaggaaaatggatataaagtagacataagttgtcagcttaaaattagatcgacatgtaaaacatgacagaaacatcagtaagccaaccaaaaaactacattttcgtaagtgaggaacatatcaaacatgaagcagcgttggccaagcgatttgttaacagtggcgaatccaaactttgcaacataacaagaactgatcaagatcataccttgattcataaagaccaatttccgatctgccaacttggtatgaacgatgaacaatgaaggaggtcatgtgcaggaaacaccacttgcacccaagtgaatcacattgcaagcaactagtcaatccaaactacgcgcatgggagattgaccccatgccaactctgatgaaggaggggcttgaattcgggtctctaatgcaaaccaccacgagatttttccagcttgctaagctggcaccttccatccgtggtccaacaaggtcaggaaattatttccaacttgtaccggtacaaaattaaatatgcattttttttgccatgcgaatgtgatcaagagcaataatcatggttgaaaacaattatataacagtgaatagaagtcgtcccctggcattaggagccaaatgattgttttgtcaaagaggaaacctcgtgtctcagaaggcaagaccaaaatcatagacagcttcggtattgaaagagtactaatgatttgtgcacaaatgatgtgcttttcgaagtcatacaagagtttaaagaccctttgagttcgtcaaggaactacacctgtatcattttgcaaatgaagaaattcttccaaattttctattcattgacgagattcctttagttgcaattaattagaagtttatatgtagccaaaatctcaagataccttaattccagcttgccaagatattctgcttattttttattaggagcaggaaatatctcaaccccctcatgtttcactaccgaatgccaactgagtcaaagcagcgctaaggacgcaacagaagtatactcggttcttcttcatattattcatatcaaaatgaaatatcaaatgaactataagaaatgtatttggtaagattggtggagttgcccgaatcatctcttttagctgttacgaagaagttgttcataacttaagtggtcaatggttttgcttattttggactttcttcctcaagtattatcttgaccaaataatatacctaataaataaatagccaagatcgatgtcaccgaacaacaatgcaccaatgattacagaaatcaaacccctttgtgaaagttcgaagttaaggtctaaatttggatgagtagtcaagagttgatggacaggaagcatgatggtccggctttcactaaaacagtttcaagtgggcggctctttcaaaaaaaaaaaacagtttcaaaagggcaacatgcatgacatgatattctttatattttttaagtcctgcagtttgtcgaccacttctgaattagctaataactattgcatggttggtgatggacagagggaggttctctcaagatcttactggaaggtccacatatggataagcaaacatttggttccataaaaactcgaagctttgaaggtagtttttcacatttctttcttcctctctcttcttttaaacccaatgtccactttattttggtatcagagcatgatattttcgcatcaatttgtggttcatttacattaactattagaactaaatgtaaagagagttttcaatgcaagaagaaaaaagcataatgcagcaaacatagctacgtagaacatggcactgaaaaataaaatttcaaatgcagtccacccgaaattactctgagaaacatggtaagtagtagtcaagctgatgtctggaaatcctagcttgaatactgctgctaatagggtcttagcaaaacctggtttgagcctgaatcgaacttcttcaggaaagcaagcctgagcccaaagccaacttgttaataacggctttgacctccttagtacaacctcagggctttttctcaatcctcaaaggcaagctttcatgcaacagtaaaatcactccatcgtgatctgcatgtcacaagttcgaaaaataaaaacagtctctccacacacacgataaggctgtgtatatctaaacacacccccccccccacacaccacacacacacacacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtatatactaactaaccaacccacccccccccccaaaaaaatacccacccacacccaaaagactcatccaccctttttattatcaaaatatatggcaatagatttaatatgacccacaccaccatccaaagtgtctgaaaacaaaattttagaaggtctaaaaagcaatgaacaagtagactaacttagatgatccaccatgcattctgcacaaagcataaccaattcatatatgtagaatgttgaagtggtcccaaattaattgaagcaaaaaactgttttcaccatattgcatgaaacacgactatcagtaaattaatgttcaatgaaatattaactagataaagtaaacgagaaagggaaataattctgtgtcatttgaatttctttggacaaaaaaatctcttacaaaaagttccggttcctgctatggtgaggcatcagtaatcaccacctactggtgtctcaccatggctggaattttttgtaagagattttttgtccaaagaaattcaaccaaatctgacaaaatcaaacaaaccaaatgatttatcaaagatgaagcaaaagcaaaaacctgaatagatcgcactggatcttacaacaaagtaatacacaccacggcatatgatacagcacaggtcggctcaatgccttcatcacatgtaaattaatgccctcaaggaaagtcacgtatcgtaggccttgtgcccttctagtaattttgttgcatatgtttctacaatagaaaaatgagctctttgaacaagttttaagctacaaattgtagctctctgcaaacattcctcgaaaggactggagatcaatgggttttaaatctgcacaaggaaaccatcagccggatgcaacgtgcttgagtcatctaaaataatcctgacaagaaaagtcagggaaatcagaacctctaaagcaaggtgtcatattagctgtttggggtgcaaaaaccaacacaggatttagacgatagagccgtaagttaaaagattttgagcacttgacatacaaatttgataaataggagggcacctgcaagcttcatccagttgaatggtgataaatggtatatttttatatttattgaatatatttttgataatttatgatgttaacatcttcttaaaaatcttaatttcataaatttattaattttttttaaaaataaatgattttgaaaaaaatataaaattagatatatttataaaaaaatagatgttaatttaattgagcaatttaagcatcaaaatgaagaaaaatttttgataaatttaatgcatatttttttttcaatttttcagatgaaaatcggagcaaaaatagagctaaaataccctaaaaaacaaagaaaatagccttcgatatacggtggacctgccgctcggtccacagagccagggggtggtccatcgaaagtgttatgcagtccacaggcgcggtctacgagcagtggaagctattttgcccgatccaacagctgaaattcatcccgacccagatccgacagtcagcatccattgctggtttataaagagaggtttttgcgcgatcggacagccaaaaatgaatccatcatgagatccgatggctgaggacgctctcgactgagaataagagattctcaacgcgatccgacggtccaaaaccaatctcaggcgcgatcggacggctgtggttcgatccgactttgataaggattaaaacaatagattttgggcagatctggacggttcaagctccatccgacggccaggaatattcctaagaaaattaatatgatttctaaggattttagaactccttttcctatcaaaaaattatgaaaaattcatctataaatagggggtctgggaataagctttgggagtagaaaaattgagtagaaagtgtaaaaaaaatagagaaaaaattaaaaaactttagggatccaaaaaaaaggagaaaagccggttcgctctacggagtacgatgaaagacggagaggtcatcaaccatcttcccaacaaggtttggctgatcaacttcagattcttgttacaattttattttattttattgttctttttaaattttttgtacttaaatttcaatttcaattaatacaaaatttattttcttgcactttaaatttctgtcttttatttttcgtaagtaaatgctagaatctagttagtagatcttagtacccgatttattttatattttttaaatttttattatttatttttattgcaagtagatgctaggatctagttagtagatcttagtatctgatttatttttcgcacttttaatttttgttttccgacttaaattactttctccaaaattttattttttttgtaaaatcaaagatttcaagtcaaaatcctgccttctctgtggattcgacccaactcactactttctacatatttttaatttttattgaagttgaaatttgattgataattacggtgtcctaacgacagcatcgcgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagtaagtccggactcactcttgaaactggtgtctaaggctagaggttataaaggctcagcctaagtggatttgtagttatttaattgatttcattagcttatctggccaattcaattagtgtctaagacaagcaacagagggaatcccacgatcccatctcttacctggctagttgaaggaagtgagaacaaacccaatttgtatctagactaggccactctacatcgaactgttaagtctaagaaacccataggtgtctaagtttaattgtttgctaacttgattgtaattaacactaaaccacaactaattcttcccaccttacgtatctaggtctagggctctttcttttttctctctcctttttctcttaaaaaataaaataaaacaaaaataaaacttgaatcatacattagggtttgcactggtatatgcaaggtagaagatctctctatcctgacctagttgaacccaatcctgagattgaacggttgattcatattaaacctgaaaatcagatggctggagatcctagagaaccacctaagcagatgaagaaatattttatttcttccatctataacccattgacttgtatccacttacctgatatctctgcaagccactatgagatcaagtcaaccacaatccagatgcttccgtctttctatgggaaatgaagatccttacaagcatctggatgagttcttagaaatttgtttcacggtgaaaattcaaaattttactgatgatgcacttagattgatcttattccccttctcacttaaagacaaagccaagtactggcttggcacaataggaagaccaatccaaacttgggctaaaatgcagcacgagtttcttaaaaaattctatcctataggtcgaaccaacatcatgaggcgagccatcattggatttgctcagcctccaggagaacaaattcatgaatcatgggagagacttaaggaacttcttagaaaatgcccacaccatggtctatctaaatggcaaattgttcaagatttttatgagaatttagatgactaatacaggcaaatgatagatgcatcttgtgggggtgcattcatgagtaaaagtgaggatgaagcctatattttatttgaaactttgagtgaaaattcaatcaatcatgcttcattatcctcctacgaaagatcaatccctcaccaaaagcggacaaaaatttttaagatcaagcaaacagactctagtcctaaggccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaacaaatataagaaattctcgataaacaagggtctgtgaatggatttgtgaactatctttctaaaattaagaacagagatgtgaactactttctaaagattggtaataaaatattaaaatttattttagatcattcttctgagattggcaattcaaaaccgttggagtttgtcaatccaatatttaacacgggataggtgagagaatcaacatggtctgactgaagatggtaaacttagcgcttattgggaggcaacctaatttttaatttttaattttttgtctttgctttcttttgcattttatttaggataatcgagtctggctttgtgtcttttgtagggatctgaaaataatcttggctaagttaggggagagaatcagttttgaaaagacttatggatcaggtgatatctctctttttttttctctttacatgcacccttcattttttctactccattgaggacaatgttgattaagttgggaggagaatataaattttttttaagtcctcaaataagttagtatttagtatttaagcatctgattacacttaagaatcgaattaaaccaagtatttttaaaagaaaattgatgtacagatcagagagtttatgagatattgagggatcaagtattaagaaaacttaataaagagttaagtttagaacttaaatagttttctttgagcatttctaaatttttctaccagcatcaaagaagagtttatgtcttatgagcttgtgtaaagtaattatacatttcttcatatatttaaaaaaaaattcaagtatttcatgctgagtaaccggacctctttgcctaagcaagtattgagtttcgcgtcaaaaagtataaaggataaagaagctttgttgtaaagctaattttaactcgtagtctgtttgattcgagcaagtaggttcgaggggtattttatacctagtgccctaaaatcatctgatttgagagtcattgattgaaaacttgctacatgggtcaaacagaaagcttaaggggttaagatattcaatagcagtacaatattttaaataaaaaatttatcaataaatgaaggatggaagtaacaatatacttgtccatgtgaaggtaaatgatttgaaaataaaggtagcgataatttgaaaaagttcagaaaagatttagtgttcttagtttaactctcatattgactagtattaatatcccaatgacataccttacgctctactgaatatcaatggtcctttagaaaattatttgatgaaatttgagattttaagttaaacagtacttgattctaaattctttctttactcgaagacgagcaaatttcaagttgggaagtgtgataagtggtatatttttacatttattgaagatatttttgataatttatggtgctaacatctgcttaaaaatcataatttaataaatttattgaattttcttaaaaaataaatgattttgaaaaaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagatgaaaatcggagccaaaatggagccaaaataccctaaaaaataaaaaaataagccttcagtgtacggtggaccgaccgctcggtccacagagcccgggcatggtccaccgaaagtgctatgcggtccacaagcacggtctacgggcagcggaagctattttgcacggtccaacggctgaaattcatcctgacccagatccgacggtcagcatccattaccggtttataaagagaggtttttgtgcgatcgaacggccgaaaatgaatccatcatgagatccgacgaatgaggaccctcccgactaagaatgagagattatcaacgtgatctgacggtccagaaccaatcctaggtgcgatcggacggctgtagttcgatccgactttgataaggattaaaactatggattttgggcatatctaggcggttcaagctccatccgacggccaggaatattcctaagaggattaatatgatttctaaggattttaggactccttttcctatcaaaaaattatgaaaaattcatctataaatagaaaatccgggaataagctttaggagtagaaaaattgagtagaaagtgtaaaaaaaatagaaaaaaaattaaatagctttagggatccaaaaaaaaaagagaaaagccggttcgctctacggagtacgatggaagacggagagatcattaaccatcttcccgacgagacttggctgatcaacttcaaattcttgttacagttttattttattttattgttctttttaaattttttgtacttgaattttaattttaattaatacaaaatttattttcttgcactttaaattcctatcttttatttttcgcaagtagatgctaggatctagttagtagatcttagtatccgatttattttatattttttaaatttctgttatttatttttattgcaagtagatgctaggatctaattagtagatcttagtactcgatttatttttcacacttttaatttttattttccaacttaaattatttttttcaaaattttattttttttgtaaaatcaaagatttcaagtcaaaatcctaccttctctgtggattcgacccgactcactactttctacatgtttttaatttttattgaaatcgaaatttgattgataatcacggtgtcctaacgacagcatcgcgatcgtatcagttggtcaggatgcaaggatatattttgtaggcagtgatgctttaaaagggcatgagaagacgacagagatctataagtggatggcacaaaattaatcaaaacttacacattatcctcaagatgaaacaccaaagaactgctccaagcttgtcgaggtgaaaccatttgaagttgtacattcaggccggtttggcgaaatatacagttcatagttgatgaacctctaaaatcacaaaagcaaagaaaacttaatattaccagccaatgcaaaaaatactcaagttgcacaagcacatatttaaaggagcacaaaacaacatagcccaatggtttgtaggtgcatcgtgatggcagggattctagttccattcttccagatttagtgtctcattgacagtcaaaattccaagtaactttttctaaacaagcagcataagtaaatttatgtaattgttttcataatttatacttgatttttcagaaagaagcaaaacttgtgccatattgcacatgtatccacataactaatgaaattcaatattttcattcaatactgaacaagcctgtgcaggtatttgagaaaggaacacatccacactctggaggcttaaattgttacacgagtcacttacagccaagtgcaatatgacctcaggatttgaatcaatatgccaatcagattctagttgtcgcacaaaagatgagcgcccattctcagtgctgcaaaagagaacctgtggatctgacatctaattagcagcagcagatacaaccaagatttcaaatagcaggtccatatgaaacccacatagtatgagagagccttattagatattatgggagcatcaaataatagcaaatatttacttaatagcagaaacacactaaacagcaatctgccagtattagaaacataagggccacacagttcaggggttataaaactgataatggctgttttggccatgatctgtacgtggtatcgaaataaaactgatcaataccatcaagcagcaactctattaactgactttcaatacattagcaattaacaatcaataagaaataataaaatgccaaagagactaagaaaacaagaagtgtcagaaaatatataagaaaaacagtaggaaatatatgaatttttttttaaaaaaatatatctagcaatcaacaatactgtcctcatgaatatggcaagtccagtgagttggtttcattatggttatgcatgtaaaggtgttagacatgaaaatctttttcttttttttttaaattgcactagtgtagaaaaagcatatattgacttaaataaaatcctttttttctaaattcttcacccatccctcctctctcctgttttttcttcaatgctaaaacaaaagattgaaaaaaaaaatacatgttgcttaaaagaactattttaatatacaaagaataagatctaagacttaacaagttttaaagcagcaaacagcttgaattgatggaatacagaccagggtacatccacaatcagcagactgggttaccagttatgggcatctacagtccagtctttcccatgaaccagcaaggaaagtacagggaaacaacacaaatattgcccaattttttggtccatgctattacccttttatcattttcaaactaacttaacttaaagagaaaattagtaagactaaagaataaaacatgaggaaattaatataaatgtaacaagaacttatatagaataagattatgcactgttgggctagaagcctggagtgactcaatggaataaataaaaattttaggctgcttgtattcgaaagtggcacaaggaattaaaacaagggaatgcgcatgtattcacttcaacaacatgcttgacgctataatttagctgcaataacatcagcagcagccttgatggagaaaaaaggattcatgaagccaagctactaaatggatgagaaaacactacgtgattatggttatgatatgactcaaacaacttttaagtacagactctgccttcaatggtcatatggcaacgatccagtactagtatagataataaatcttcaacaatgaccacctaactctaacatcttgataggctgagagcccgcaacaaggtgagtggtcttctatggcaaacaaatggtgactggttttcagtcacaacaacaacaggtgctcttcagcaacagatgttaggcagcaggaacccacaaacatgagaggcaactacaaactccaggtttttacccctcctttcctctcccctgcggactctctttcccctcttccacttcttcccactgccatcatatgcctttcccaccttcctctgcagctccctggctgctcacataccatgatcattattttgtacctcagaaaagcacagacatattccctggtacaatttctagcagttgcaaggttgaagcatattataggtgccttatttaaagtcagatcactccatgttattcttcctattccctcgacttatggtttcatatgatgtgaagcatttatatagttaaagcaaagaagtaaatgctcagcgtctatacatgtggattcaagatatatatccgaatctctttaaattggtaacaagttctggaattacaagatgctaagttggtcaggtaattttaaattaagggatcaaatccaagattttccttggctcaaatcaagatctttgtagaatcaggttaaaactgtatttgatgcaaatattgatggcattgacatgttaaaatcttcagcaatgcaaagaaagatttaataaaggatctaagcattgctctggtccctaacagccatatcaattgcaccaatcggaacctataccacaatgccccccatgctgtaccattgcaacacatggtatttcgcgtccatcttgctatgctggcaccaagaagtgtaccatataccaataagatgtttaccatatcggtccataccatacacgtaaggtacatgtacacttgttaccgatactggaaaccttggaaacaatgttagttttctaaaagtgtaatttcatccatctaaatgcatatgttaacttttagaacaacgaattctgtgatctgcatcaactacgagcatgcaaacttacatttacgtgcatgatatatacaaggcaacaactatggtgttgctcaagtatactaaatatttatgctatagcaacagaagactactcagcaacctcactcttgatatgttttttaaatcaaacttaagaagaatatgtatgactctagaaataactgcatgctaaaagagaagatatgccagctttggatataaatgcacaagatagatcaacacctaaaagaaggtaacaagacatattccataagacaatccaatcataacatttagccatttataaagatgatacaaagagctataactaaaaagataaaatagtgcattaaaagaatcataatatagaagaaactaatacgcccataattccacttcaataaaaaaaattaaaaaaaaagaagtttctattagcaacaccattaactagaaaagatatcgtaccttatcactcatcagaccaccagacatgaatactccagcatccttcaaagctgacagtaccctttcctgcaccattgtatcatgtgaagaacaaaaccaacatttttactggtaggcatttatggttattttacaaagtctaatgtgcatgaccaaaagggtagcatataattttcaatgacaactataacttcttaaattattccattcatacttagggcacacatctagaagcactaaaatttgcaaaaagaatattgttctgcacaaaatgaagaatttttataaacatattttgaatctttaaatatagaagaatgtaaataaaatgcacacacctcactttcatcatcaagaatcctttccatgagataaagatcacagtattttgtgatctctaacagtacttctagcacagaagacctaacagttgcatgcttctgtccacaaggaaacatcattaattttttttcaatctatgatgaaatagaaacaaacagttgttccttaaccacctggagttcctctggactagtctcctcaagaattacacccagcaagcggcatgtgacctaacatcaacaaattctgagagctgagaagatgatgatatcccatatatactaattttaccaatgatacaaactccattcatcaaacttaagctaattgaaaattcagtgatccttatgttagtttttggtcagactactactaaaaatagtgagctccaaaaatgacaaataaagaaatcaaatgcacattatatttctaactatttggagaaggtatagggctgcagacaactctagaagtgatcaagcaaacaaggttattgaggaaatattaggttgccttatagtaaaaagagaaactgaatctctgacacataatactgtaagaactttccaagttgcaccataaagctaaaaagagagattttccaatagctaaaataattcagatgccattgttggtgtcatcaagaaatctgtgacatggccaagactgatacatgaaccatctatttgttgctaataaaaagataggtaccatagtggaattatgaggatcaataaagaaaaattaccttttaacacgaccagctttgtctatgagttggaaattaataaagcttaaagaactatcagatatttatgcatcaaatgcattccatagcatcaaattgtagtggacatggttcaatatagtgcaatcagaatcattctctacataaaaggtaaaagaatggattctcattcttagatgacaatccaattttcagaacctttaccttctctccaattagaggaaaaaaatgcatgtcatattacatttcaaacttcatgatcatattaaccctacttgcaaagcaactgaactgtgtccaaggattataacttcgatttgaacaatgaatgacgcaaatgtgaaatgtctttaacacaatgcaaaagaaaaaacaagaaacataaaatgacaatataactgtaagagatccatgtgttactgttgaatcttgggaatttgtctcattgggaaaaaggcaatctaattgcctacatgattaaaaaattctaactcctggtccattttgacttttataaatcatttttgtcacatagctaaattgtctcacttattcttgtgacacctatattaccataagcataactatagtcatcaagccttattcccagcatttgctttatgaatctttatttgccaaagattcctgttaagggcaaattccggcattaaaccaaggttttctttaatgcatctaatatttggatttgttggatagtctaatcttcctttcagaactagccctcaaactaacatcaattttccaccttttccatctgagctttgggcttagactggcaatgttctgttcatagctagaagaacaaataattgcaacccaggttagcaaccctgcttcccaatatttgatgatctgtggtgattaaagcctcattggtaatgcccaaaaagctccaattggcctaataataatgttaatcatccttccagtgcatgggaatcaaaattttgtaccgtaagatggaaatgaaaagcacgagggttaatattgcataatcagaagcctgatcaatgtttaaaagtagaatcagagtggtattatctgtcctcacatttttaataccaacagggagccataattggtgtagatcgagttgatactaagaagtttgtttccttttagcatagaatttctacaactagtttttctttttactaccataaggatttatttttccaaagtagctttaaaccattgaattgtgtatctgcatatttaatttggtatgatcaactatcgattgtcaaagggaatttagaattagcagatagataattattacaagttgaacaagtagtttggaatgtatgtatcaaattgtaagggcactgagttccttcttatacctctcaccaattgcatggaatattatgtaatttcaatgctgatactttaacaaggccatgattcttgtttcttcaaattgtttatatatagttgttccagtgaaaggaataaagtggccttaggaaaatgactagataaggaagctagaggtgaaagtgaactggataatattcattcaaatccgtttttgtatccgaatctatccggatatagatacaaatttaagcatctgactaatatccatatccgtatctatatctataaaaaaaaatggatatagatatagacagacaactatccgatctgtatccaaatattcgattttatttataatcctatttaaatttatatatcactcgagaacttttacataaaatatataaccacattaacatactactaattttatttaatatccacttagtaatatctttgattatgtgctcataagatttaattatcctacttatatctgcatttgtatccatacttcaagtattcaatttgtatccgtatccacttaaaacaattatgaatataattttttgcatccaactaatatccgtatccatattcgtcaaataaaacaaatatagatatggacatactgatatctgatccattttcagccataaaggaagcaagtacatggcatgtcaacatgtttggcatccaaatgtaatcccttaaggcttggatagcaaattagctgagatgagttcagcatgagcaacctcagatgtatttctaacaagcctaactttaggattgtgcagcaaaattgtgtacttaaaattctgttgttgcattcaagaaaagaaaatccattttaactgtcatgcagataacaaattgacggaccacaattaccatttgaaccattggaaccaaattgagttcaattttgcaagacccagacccaaaatattagaacaacaaagtttggtctgaaattgccaataggtaaagggtttaatcagagccaagttgggtggatttctgtttgaatacaaattgccctaatagcttcacaagatgatttttcatttaaggtacaagactagagaaaaacaatcttgaagttccattgcacctagggattaactcaaatgtactgttatgcctgacgctgcaaataatacatctagacaaaattaggatacttgatttagaatcaaagaagcaaacatgggtatccaatataagaattagagaggttattagtaatggtcaagctaaaataaccctggtcagattcattacaaataggaatttccgtggtcatcattcaagtctttatgcattagcagattggatgcagttattattggagaacaaatgctcctgcataaggaaattaaatcctatatgctagcaaaatgactaatggatatcaatggatgacaatgttggtctaattgtagatcatcatccttcagaaacaaatgttattgtataatagaacaattctttctttaaatgtagcttaaaaacctttgtttagctctttgaatttcttttgagcaaaatactggtaacatgccaccaatagggttgaactgtagacctcctccaagggcaaggccttaggagaggggtgccaacaagctgcgctgatagttattggattagctcttataattaagaaatagacattatgatttcttaatttctttgtgttgaacctactacttacaccaccaacaactagcttgatttctttctctcatgcatgtgagaccttaccttcattttaaaatcttaaaagaaacacagccccgtaaatacagaatgtttacatgtaaagggagagcatggtcaaactgtgccggtaaactagttgtttgcttaatagtcaattttttttctcaaaaaccttcaaaaatcaacagaaagtcgaaaccctgtatttgcataaagtaaatcttggatcaatggtcgttttcatatacagtgtgcttagactcaatctgtcaagatcaaactcaaagtcatctgtatagatttagccaatttacgaacatcgattagaaaatggcaaagaaagatacataatgaaaaccttatgtcttctgcatatgacaaaagaatgctgccaatgattataatagatagataataatccttaaatctcattgcaaacacaattttatgtagaccttctaacatgacactaaagcaagcttcatttgacaaaataaaaggaccccgatcaagatcttagtaattctgagaaatgtcattaattaaatggtacatatgtaggtcttaattttgaatttttgggtcagcacgtggatgtgttttcacatgcatgtgattttattaggtgagagagagagaagagagagagagagagagagagagagatggggctgagagaaaaaaaattaaattaccttccttccctcacctagtttttgccttactgattgactgagggtcggctgcaaaatggaggaggaagaacccatttctaagtcgatcaatttaagtgttatagttttaaggagaaaaagtgaacaatagtaccttcgttggctggaaaaattcaccaactacatctttcacttttaagtccccagaagatgtacaaacttcagaagattgcaccatcatgttcgtacgtgagcttgcattagcatgagcaggcaatggtcctggccatttgcgtcgccttctttgatggttggaaggagatctcaaaagcttccaagcaaagacaattgcaatgacaagagcagcaagagtcctggtagaacaaaacttctgagacaagtaatgaacaacaaataattacactcttccaactaattaaccttccccggacaataacattagttcaatgagagacatgtttatgtgcaacacaatgagcaaatcggtctttttctgtggtaaaactaattcagcacacatttgaaaaatatcaatatatctgaaattcacaaaaaaaaaaaaggcattttgcatttcttcaatcccaaacagagatcaaacagagcattatacctaccaaatgctcgtacaatcattaaagaaaaatttagaacaaatccatcaaaattaaccactctcctcattacttcatccgagtcatgaagacataaacataataatttaactaacatgttacacaatctttctaataaatacaaagcgtagaagtcgcgtagaagtccatggaaaaaagtcaaccgccgcctatcaagaacacatattccatgtatcatttgatataatatgctaaaccaaggcatctccatctttaccaatcatctccagtctggacgcctaacattatccgcagctatcatcaacaagaaagtcaggtcaagagcatctagtttcaagaaacagtcataattcaagcacaaatcataaataatcaatgagtccaatccacaatccccaagcaaaggaataacaagcttcccaagcaatcaaacaagaacacacccgactacggagatcataccgacccaagaacgcaaattggaaaaaaaaaaagagggacacatcagggaccaagaacctggcgatcaatatggaaggggaggcgttcggacacctcggcgagcgattccacgaacctctgaatcagatcgacgagctcgtcccttctcgagtccaccacgggggcagtcgacgccgccatggtggaaggcggaggcaccgccgctgtcgccaccgtgtcaaatggacccagggaacgacgaatcgggcatgtcaggctggggatttcgccaagcggcaaaccccagaaacgggaagcgagagagagagagagagggtagcacgggaggacgggaggcagggtctgggaacgagtcaaagaagcggacagggatggtaaaattaatcccacccgatggatatatattttatttgaatccgatcaaactaaaaaaataaaatttaactgaatttaaatataaatttaaataaaatttaaaaattataatacagatatggatagaatatagatagtactattttctatccgaattcgaaccgaacctatgaacatggataatatccaaacccatattcaaatatatatatatatatacacatatatatatatatacatatccaaatatatacatatatatatatatatatatatatatatatatatatatatatatatatatatatatatatatatatatatatatatatatatatatannnnnnnnnnnnnnnnnnnnggatataaaatggatggggtatggattgggtatggggtgagtatggattgggtatgggaaaatgggttatccacggatatccctgaacccgttgagtatggggatgggtatctctttttttatccgattgggtatcggatagggtttggatataggatattaagttcggatttgaagatggatagtatactatccgatccaaattctacccattatcatccttagaagcgaacacgtgagaaagcccaccgcaagattcttggtgcatgtaaagaggaacaggacaaaacaaccattttaaaaacaaaacaacctaagccgtgtatatcctaagctgtggagatcttgctttccgagttgtacgaaataataaaacaacctttttaaaaataaaagcttttctctaatcaaaggtcaccgtcagatggatttatgacgggaacattgttgcagtaaatgcttcaccacaatagtaagcttcttcctctcttttgagttgcctcatattcaggaaaaaaaaaatcaacaatgtagctggttagatatctagatgacgtccatacataggctgcattacccccctcccccgcgcccccccctaccccacccccaaaaaaaaggacgaaaaactttacagcatctccccattcctcattttggtctccaccatgcgttaattggttggtagttcatggaacccgaacctcatctggtgaagaaattgagcggtgctgggaagcagcactctagtagtaaattctctcttgggcttggatagttggacaggagtcctaggttaggtggctgagtagatgcatgtttgtgaaacccaatttgtatgatagtttggtaataatcagtgggtcagaaggcttcccgattagtccaacttctgatacatcacaagctttcccgaatatcctacgatgccgcggaacgtccctgtagaatttgatgtcactgtcttcgcccacgagccaccgccgcatcaacaaaatgccaactcggcaagggtaggacgaccttcctgatgcttccacattgcattgcttccgagctcatcgctttcgccgagcatgctgtactctttgccgggtttggagggcggaagggcgacgacgtcgggtagactggtgagacgaagaagagacagatttgggcacgggtgacaaggtcgaggagggaaaccttatcggcattcagcatttctcctcttcagcatctatttattcgattcttttttcttctagaaaaaaaacctcactcggtgaccggaagataattcactctgcaaggatctgaattcattctccacaactaaagttaccacccatcttgctggaaaaaggattccaccaccaattcacctttgagatgttgcaaccgcatacatattattctccaatttttatcaatgacaaccacctcctattcctttccaatccgaaccattggttgagccagctttggtactccaggggcttgtctagaacgttcagactcaaatggtacgaaacacgatcgaccttcttgtatttagggcaagctgatgccgtcatacacagatctttttaacggtttacgctgtaatacaataaagcaatctttcaatttctcaattaaaatgtgccatgaactgagggttgtcattgtgattatatcactccatttaaaaccagagaaaattggaggctccaacttcaagtcttctcccaagcaattataattcaagcgccaaccatttccaatgctcgggagaattaaaataaaataaaataaaatccccctctacagcccaaggccactggcccccatgctgctgccaaaatctgtttttgttaccggttacgcgtgatggcgctgcaacccaatcaaattatcatggatatgacataacaaggtgaccaaaatcttggataaaaatcacggacaaactgcataatgatgacaagcaccggaagacccttaacaatcaactcctttacctcagaaatctaagaccaaagaaaaagggggaaaaaacttaggtaaaggcacttagatcacgatatgcattagtctatattcctataggtactaaaacgatagttccatccattgtcaatatttacacattacagatgcttattggaaatgtaatcaagaaattttgttatttacaaatgcgcggagaaatggaattccaacttcacaacatcaaatgcttccacttcacaggaacccctctcactttgctttacattgccacaggtatatatgtatataaacacaagttaatatcccggggtagaataaaagaatagctgctacacacctgagaaagatctaagcgttccataagcctctgaaaccagtgacctgttgaacacaacacagaataaagatgctatgcgaattagaacatttacaatatagagaggcactacaatttgagacaactgatgttcccccaaaagaatcatgcaatcaccaaaatgcacatcgatattccacatgggctggtatagttgtattaaagatcattataaagacagcaatgtgcacgttgataatgcacatgagctggtataattgtattaaagatcattatatagagatcaatgtgaagtaggaatattattttggtaacccagagcaagttaagagcagcaatctcttgcagaaacagacaaaagtttcgagtttgaacataggcatccatctcaggaaaagaggaaaaacagaactgataccatttcttgagtgcagagaggagcatctaattactgtaaaacatgtgtttcaacacttggaacaggaagcaagcttatgcttagtttatactttttctgggtccaatgaaaatgaaagcattatccctcaagtcagacacaaaggaccaacaaaaagaatatacagtgtgtttgatgttgcttctcctttgaggagaagctagaagccaggctttctagcctaaatgcattttgtctggccttttcctcatgtaaaagcattatttagatgaagttaccaaatgctggatttttaaaaggtgcatctttttttaaaaaaaaagtcacaaaaataccatttttttaagcaataccccacaaaccctaagagaaacaagtcaaccaaggggagaagtgtttcttcaaggtccatcaaggagcctggtacaaccaaaatatgtatgaactctgacacacagaataaacgatcaatgggatcacctcaggaaaatggcaactaaaatctgaatttcaaagtttgccagatcaaagttcaggcacaaagactcctatgatgttggaaggagtaaaacttacaaatggtgcgaggactcaaaatcttgattataaatatacatatatatgcatacatatgtgattataaatatatatatgtatgcatgcatattcatatatgtatgtatgcatgtatgtattcatgcatgaatgcatgcatgtatgcatttatatacgtatgtacgcatgtataaaagaatgaggacataatggtttggccaaaaacactaaataacaagagtgactgttcatgatgatagtcatcttggcatgtccataagggtatgaagtatgtgcaggccattactagaacaaatcaagaaggtaaaataaaagcaaagtgaaggctataatggcaatgccaggcaatgatctcacctacccctgcacaagggaatcaacactgcgctagttaggcaaaactttgcaatgaaatatcacctaagaattcattagaccagcagctaatcttaagtctagaacaagaatgatagttatcacatcacatgcaagttaaatatagcccatgaagcttttgacttgatggtgtatatacatatagacacatatatatgacatatatacatatacatacatatatacaaatgtgtgtgtgtgtgtgtgtgtgtgcttgtgtgtgtgtgtgtgtgacatggatatagagagagagtaccaagaaaaaaaatcttaataatacgttaaaagttgacatcaatttgaacatcaaatggtaactccatgctcttcacttccaatgtttagctaaatcaagctaccacaggcaacttaaatacttcaagtcagaaaacgctaagacagtcaaaatatttaccttagacaaagtcattatcataatcactgaattgagtctctgtcttcaagttctctttgttatttacagactcgagctgggcctccatgttcaggccctcactgtcatttacaaactcgagatgacttttcaagactgggctatccatatggttatttacaaagccctcattagcttctgctgaggatcgactccaaccattctcatcagtgccatttggaagctcagtcaatgcagcattttcagacatgcactctagcgaactacagctgcttctgcttgagagccttccttctgacagtccagatttttgacgcagaagtgggccatttctgttcatttcaaaagcatttgccataaatcaaggacaagggataaaattctaagtagcagaatagaagtttgtagctaagaatatagatgcaagaattagaaagggtttcaagatgtaaacatgaaggcttactcagaaaaatgaaacaaagatccggacaacgcttatgacagaaagcaaattttagagcagaagccaaaaacaaaaaaaactccacatgataatacatgcatacatcagaagagaaaagttaacatttggcagagctgctaggaagtcaacgagagcctcataagtcataactgaaaatagtaacttcaaaggtgcaacctgacaatcacaccaaatgccataaaaagatgatttagtattcattcccgttaactccatggaggatgaaagaaaaccgacatttcagttagacaacaaatcatgagaatgagatttgagatattgccatcctggatggaactacaatatctataaaagtacattcagaggctaaggctgggtttcttaagatgtctttccatatggttacatgtaacataaaaagtacaaggacaatttgcacaatagaacgaagattaaaaacaaattagccacttactgcaacaagtcagcccaccagataatcgaaagtgttacaggagaaaaagatgcacgtgcatgcgcgcacgccacacagagagagagagagaaagagaatgctggcaaggttttaagtccttgcaaaatgggagttcccggccattccaacatttttcctttaagataaaaagactaggactgggtggggcttcgaaactcattcatgcagagaaagaagaagaaagagaaaaaaggnnnnnnnnnnnnnnnnnnnngaaaaatggaaaagaaagaaaaagaagagaagaaaggaaatgaaggaagaagaaaaggatggaaaggaaggaaagaaggaagaaaaaaaacaaagaaaaaaataaaggaaagaagaaggggtaagggagactcagagggcacctaacaagatgctcaatcaagacaggacagtaaggcatctaattcatgacatcctgccccatcgaatttaaaacattgaatgatagcaccatttagtatctctatttcatcaaataaagagagaaccatctagagacatgcttactaaactccaagatttttcataccgtgccgaaccgaccggtacaccccgtatcgtaccggaccagcgagaaagagaagaggaaagggagggaggtgggagccgccggaggccggaggtggccggctgcggccgctgaagggcttccgagccccgtatcgcccgatagaactttcaagagagcgagaaaaagagagagcgctcagaaagggggcgagggacctaccggacggacggcgcctccgtcgcgagggccccggtggccggcgagccgacgccgatggtctgaggatggtcgagcgggcggagctgccttcttctttttcgaaacagacgaccatctgtttcgattttttttttttttaaacttatgaagttggcaacctagttgccgacttaagagatttttaaaagaaaatacaaaaatcgtgaagccggcaaactatttgccggcttcacttaaaaactaggtttttttaaaaaatttgcgaaacaagggcgacgcccctgtttcacgcccgcggcgccgcgcgcgtggactgcaccctccggcgaccacggcggccagtcggaggccgtccgacggccccgccggctccttcccctccctctttttctttcttcctctttctctctctttctctctttttttcttccagttcggatccgcttgccttcgtcggttcggtacggtacgaaactgtaccaaaccgtaccgccggccggccaatacagccgacggtaccggttcaacatacctttgctaaactcaaataagaacatgtccataatgttacccaacatcatctacccaccccaccgatgttagtaggtccaagatccctgaagaagctaccagcaaaactgtaacatatggactcaaatgaagttgggccttcgggttcatttcctccaaataacatgtggagatatttcctccttcaagaagcaaaatagaaattatactaccactttctcaatatccaggtggttgcaaaccttaattatctccatcaaaaaaccacgtctataatcacattgttcctggagatgacccaatgcgttgctgctacatatagtagaaagtaatggcaaagtaaaacctgtccacttgaaatggattaggaagcctttggtccactttcatgtataggcaaagtccaaaacttcaaaatagcaggaaaaaaaaaaaggcttatccaagttactctcagacatcatcgcccatgactactttagcagcgataaccactactcacaatttttaaccactccagaatcattctatttattttcaccatgctatttttctgctttggtggccaattcatactgagcattaacttcacgaaaaaagaacagctacagaacaataatatcaaacaaaaacatgaacaaacaacagatgcaagccacatattccacagttcaacatcttgagagaatgaaggggtgcaaaccacataatcaatggtgaagtgacttgagagttgtgcaaataattctcaaatccctaaaatttaaatcatatctaaggaaaacaatgaaatgatgattgcactaaattaacttgcctaaacataataacaaagaaaattcaaagaaaaaaaagtacttttacaatgaaagcaaatgaaaaccatgatatttctcaggtttcaatctccactgacagaagccgtctgatatatatttgaccttgggattagaagtgttgactaattgcctagttaatagaggggaaaaagttcctatgaaaaaccatgggaactaaaaaaagagaagaaaaattaaagaacagtcaaaatgaggtatttgtgtgacaattgaaaacaacagatgcacatgagcacatactcacatgcataaacacaagttctataaccaattgtaatataatatatctggatactgctacctgttaaaggttactgcatgattgcagcttaactactatgtgctcctcaagttaactgtgaacaagtcaggactcgtaagaaggaggataactccatccagagaatagttcaagcttttgctaacgtgtcaagttagtatgcaatcaagcacatggtcttatgaatctacttgaaaactatcacaagccaaattatcccctttactctgtgagagagagagagaaagagagagtcatgaggcactaatgttggcattatgttcaaaacttggctttcacttacatttcactgcttgcagataatgcactagctatagtgttaaactgtgtgtttccctctaaattcctcaaagtctcagcagactttggagggtagcttcttaactgtggaagcttgaaccacaaactaatgtaggtttccaagttgccaacagattttctgataccatggtaaacttctctctttaacagtctcctccaccagagaaacataccaatcttcttcccaatctccttcgctagaaaaacatagcaacttataggttcaaaagacacaagaattcgtcatgtataaattacaaataacataaacatatcataaaattggtttttgcaaatagttacagagattctacaatgcagttgagacacatccaagaccagtctccaaaatagaatgtgttataaacatttctcaatacttatattcaaatatgggtcttccaaacatacattttcatctaaacactgtggtgcaaaaaatcataaatggcaatacagataaatataagagagcatcaaatgcaattcatgacatgcacatatatggggtcataatgcaccttgattgctggaatctgggtgttcggatatagtcaaacactggtataagatcttttgacctagcttcgattgtgcgggttggaatcctttctatctcaatttctccagatgatgtattactattgtctgctttgatattttcatccgtcattacttgaaagcatatctggaaagtaaaattaaaccagtgaaacaatggaaacatagattcttatataaagatcaaaatcaatcaaaagaacaaagcatgttacaacaaagaatatgtgcaagtacctcagacttcgcccataatggaatacggtcagcatgcatctgcaactcaacctcagatatatacaagtgataattttcttctgcactgagttttactttcatgtctgtagcactatcagcaggatagatactggttcctttctttgtccctttctggaaaagtttagtgttttctccatttccatgatcaccatatatatcaacatagtcaccgcgatctcttctgtttcgcttgtgacaaacatcccatttctgaagtgcctcgacaactaacctcgcatcagtttctggtgatggttcataagaaacagtgcttaacactgatagatcaatgccagaatcctctccattgcagtgacgcagcacatactgtatgatagagccagaaggtgagaaaacaagcaagtaatattttgtccttgatgaactgttatcaggatatggaccacaacccttgcaattatgaaaaactgaagcaatagccccagaaaggggactgatcctgcctgtggcagctgcagcagcaccagtgacggcacctttccatccattactcccattccttattctgcttacaactgataacgtgattggaggaccagatggaaaaagactctgctgattaagcttcattaaagaagatccatgatgccagcgaactgatgccttagttgttagatcagttccgcaactgatactcatcatattgctctcggtggactgaaggtttccagtcccttcaaaaggagataatgcaaataaatgactggttcctcttgaggaactgatcattatccattggctgtcatcactaaaacttatgtcttgtataacctgatgtatgcaacaaaaatttctagttagaagtcagcagatgcatttcaaggaaaatgcaaaacaaattgtacgtattatctaccgcatttgtgatgccacgttgcaacctgtaaagatgaatgtatgtcccatttgcatcagatgctgatgaacttccatgtagagaaggcattatgcggaaaacattaatgttgtgaccatgaatggaagctgtcactaataatgtgccactaggatcaaagcataatgcagaaataggacttccatgtgctctaaactgaaccacaactgacttagaaacaatatctctaacaatgacctgcaaatgttaagtaaatccaaccatcaaaattcagaacagtgactatataaaaagacataatacatgtttttcttaaactgtcagaagagagttcatgattgtatatgttagatggtaaatcttctgttcaaggacacgaggaatatagcaagtccaacatagttaatttttaatcccttaactgaacttgggggaaacaagaaatagaaaagaatctcaggtatcaagactcagaaacatcggtggagaattgcataccattccagcactttttatgtccagcaaatgcccgttaatggcaccattaatttttgggccagagctcccatgtttaacagaaccattgctatcaggcagaagttccgagcagtacttggatagcttcttatatcccatatctccaagtgtcactatgctagcagcaagttgcttacttgattcttttgcatagtgtgccaccagactcccatttgcaggagatgttgacatagccgtaccaggactcaaatgttgtggactgacacggccggtatttgaaactgcaactggacttccactataggccagccacctagaacccacagcaagtggtccataccctatgcctccagagccaggaatcccagaaactataggataagtaagaattgtatattctctctccagagttgcagcatcaaaacaatgtatctgtaacacagtttcttttcttaatgcaatttttgcatacgtaactatgtagaaaaaggaagttcatgtaaagtgtcatgcatacctgggaggcttgcaaaacagcaacaactcgaggactgcaccttactgagtaaacagctgtcctgaacttcaagacatgcacataatcatgtgtccttaatgaataaaagtggacaaatgttggtaatggatactcatttcccagctcctgacaaccaccaggacttccattcaaagaggagccaaacccatcaagattatttccacttccagaaaatgatccatctccagcaacaaccagcaatggacgcacatctgcaaatttatcttcagagccctttgttgaaattgacttctttagcatttgcagaaatgaaacaggcccatcatgtctggaaactagctgccttacatcatctgcctgctcaacatcccaaacctgaaaaccagacttataagccagcaacagaacctgccgcaggacatcactctcgcattctaatttgtcgaatccagcccagtgcaccttttcaccaatgacaaaaattgtgaatgaaaatatggatgaactagtgttgtacctctcaaatatagggtattagttcaagacatacattgaagaaactacaagaaaaagcttcagatggtttactaaacctgaactacaaagctaagcaagtatgcagaaataagttatcacatcaaaacgaaaagaaaaccatcacaaaatggtatttttaaaagctaaaagaatattctatcaaaagataaataaaagagcttcatgagttatttagatttttgcagctcatgatcctgaaaaagttaaatttcttatccactgcattgtatttattcttcgaaaaattttcataaagaagtcttgttgctgcatgtgcttctgtaacagcaagaaatcaactatcgttacgaaattccatgtcacgacaactagatgcgacgacaagcatgagaatcgacataaccacgtagagcaaggacatcagaaaaaattctaaattcgaagttgccaaatagacatgagaaagaacctgtgctatccgcaaaacgctcagaagatacaatgtctggccaaaagtttatcattttccaagaaaaagatgtagatatttatccaatcatcaaaatttaatctagctactatacaataaaaacctggctcatgcatgcagtcatcaattcctcatatttgaacaactgagccccttaaaaaaggcatacttaaatcattccagtaataatttctacttcaataatcacatacacaataaagtatgcgatcaagatgactcttttctggaaactcattcaatatgcaataaagctacaggtagagaaaaggggaaactttaaatttcagttaaatttcagcggtgtccatcaaagaagcaaaagatcaaattctttaaagaggagaagggaccgccatgagtacctgatcacgtcctgcatcatcatcgcggtccgcaatcgaggacgcaacggacgcgccggccgatcggacggtggatgcaaccgtcgaggcgcccgaggacacgatccttatatagttcgacaaggagcggagcgagaagaagccgttgttgctccgcccgttcctcggcacggcacctccctgaggcctctgcacatcgttcctcatcccccacccccgaacccctccaaaaagccgagagaaagaacccaagaactagaccaagaaccctagcttctccgatccggtggcctccgatcataaccccaggctgtttctttcgaacttatcaaacaaaaacagcccaaatccttcctctaggtgaccaacttctccatcacaagcccgcccctcgaaatcccttcccaaaaccccagaaacaacgccggatcaaaaccaaaataaaatctttcaatccaaaacagattccgacaccagaaaggaattctgcgtgtaaaattcgaagcttctggacggtgcccaacaaattcgatcgaaaacccaaagaaagggagaacaaagatcaattcttgcgcctccggtcgtcggaaaacaggcggaatgggggaaaggcgagaattttttattcgagaagagaagagcgagatgggggaagggggagaggaatcgcttgtgatcagataatgaaatgatgactcgccgtttacgtctctctcgctttgttttctgttcttttcctcgccttcttgtttccttttttatctttcacggtttcacctcccctgctggattagagttaaagaaaaggcgaaaagaaaaaagaaaataaaatagaagataagaagacaaaaggagattaagttaggagaagaaagggttaatacctaaataataaatattaaaatataattatacgattattttgtcctcctcttcttccccaagtcaagggttttgacggacggtaaaaaaccggtaagttcgagttttaaagagggagccgaagagaaaagggaggcttacgttatccctccggaagccttttaagtaaacctagccgtgcacaaggacaaattagcgaaccgtcgcgtctggttggtggggtggattaacgttagaagaagtaaatggttgggctcgtgtccccggtctaacaacaattaaggatggagcggcgtagagcaaaccatgttagggatgattgtacgttacttcttatgcgggagaacaaaatagaggtcaagctttcttggattacgtagatgatctaacggtaaatcgtacgttcgcataatcatttctatgggagctgaaaatggacggtcgaaggaagagaggagtccgaggcgtcaacgtttcacttctccagcgaagcatccgacgcagcgtacttgggtggataatctagtctgtaggattaattgctcacggtgatcaaagggtgaggctggtttctgccaaaagaaaaaaaaggtgaggctggtatggagggaggattgttgggtatgtgcaggggccgcacaaagtttatcaggtgaagatatgtccgcatggagggagggaagacagtgtcgcttggaagtttctgtgcggacatttcatttatgtatgcggtgtcaaggtcagagaagagggagggagaagtagtgtatcagtgagaccacgggtatatggatggatggagatgcatttggcgattcttggacacttgactttttgggtatgatgacaccctcttacaaatggaccgcatgacctcattctgtagccatgatttcctgtgatctgatgaaggcaatctacctttcctttggcgctcttttgtgggatcgtgggcaggtttgcatgtttgctaataatgttcaacggtacctttatgaagattttaagtgaagggcttgtatatgaccttatactcaatcttttccactgctttggatttcggaacaacaatcgtcacttccatggatttataagatgataggaggagatcaaagaacccgctgaattgactcctgccagactctttaatagttaagtgagagaattttttttcactggagatgagaagaaaaaaatagttgagcgatagaaccattcaatagttgaatatttagtagtatatttcataaaagatctgtagacttatttatagccaaggtctcgaatttcttgtgaattgtcctaaaaaattcagggtcatattgtgatactctgctgatatggtgtaacaatctaaaggcatgctgtaatcatttggcatatgatggaattgctagaatctcatgctcatttaggcaaaaaagttgagctacctctgttatgagaagattctactcagctcaagatggctgatcgtcagctttaggtttggaggtcagttgatttgctgatcttagctttcaggttgattagagatctccaaccaaaatgccttggagaatctgcaaatatgtctagatcaccgcatagatcctgagctggatgattatgattgtgccatgtcacgaagtttattttctactacaactataacacataacagcacactatatagcttccttgagatccattaatggcaaagatgaaggtcataatggaataaattaaacatattttgaaacgaacggccttgatccaacaatgttttggcaaactagttatccaacattatggatgcaatcaaatcatccaatgatggacgtatcgaacctcatacattctcattcagagcttgttccacttttcattagagcttgacccaagttcatccaaggcagcccacaacagacctccaacccacagcaatatagttcattggtttgtaaacaggaagcagaggtcctgtcctgtcagtgaagccacgaagcccttgacaagcacgacccaaaaagcaagggcatggattgctagagactatcatatgtgcaataatatatgggctttggattgtgcaaggggtagtggagataatttcagtcaaggatttatagcaacttttggcatagttgagtagcacatcactcctcgccttgctctccagggggtgtctagggttcaaatactgagattactctaaaattttataatatcccggttttcccagaaaaattcagtgagatgtatgtgtaaattggaagatagaattaagatgaaggaggagattaatggggaaaggagagatcagattggaaaaggagttcagatcgaagaaaaaaaagttttaaaggaaatttgaatatttttctttgcatcccttgaatctctgttacagctcccttttatatatagttacaggtaatgtaaatgcaatgttttcaaaataaaatacaactctaattaaatggagatggtatttttcagaaatgaaatacaaatatgaaatgaaatgcaaatgttcctaaatgaaatgtgaaatgaaattcgtaaaaatatttttgaggcttgtcggagcggattgttcggtttgatggctgaatccataacctaaacctgacaaaataaaagggttcggaatactctggatcctgtcgcttctcctgtttctttttgtcttcctctccgaaaccctagccgactcttgaccctcttttgaaaccctagatgctcccgaggaaggagaagggtgtatccggcgtggatcgggatctcctagagtcagaccaagtctttctggttcttttgctcctctaccagcaatcctgatgagaatgagtatttctaactcattttattttattttattttattttattttatttttgctaagatgttacattcccctcttcttcagaggatccttgtcctcaaggatcaaactgagggaactggttcttgagtgaccagtagtcttcccatgtagcttcttcttcaccgagattgctccatttgatcagtactttggtacctgctctgtttcccttgtggatcatttttctgtctaaaatttttttctggttggactaacagttgtccttcttctcctgtgagaagtactgttggtgttgcttgctcagatttctgaattccccatttgagtagagatacataaaatacagggtgtattttgaatccctcgggcagattaagctcataagccacaagaccaattttttttagtattttgaatggtccataatactgtgaggtaagtttcaaatttttgcgcatgactactgtagtctgccggtagagttggagtttgagatatataatttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaatggtccataatactgtgaggtaagtttcaaatttttgcgcatgactactgtagtctgccggtagagttggagtttgagatatataatttttcctacttgatattctttgtctattcttctcttatctgcattctgtttcatgcgattttatgcttctttaagtctgtctcttaagatctgtatcatcttagttttttctctattccaatctgccactgtaccttactgttgcatgtccatgttgactatcgatatataggagatggatgtccatacagagcttgataaggtgtcatccctagggagggtgatagttggtattataccaccacttaatcagggatagccacttaagccatctatgaggactgtgaaagcatatgcatcttaaatatatttctaagaatcggtttactctctctgtttgtccatcaatctatgggtgataggcagtatttagatgtagcttgaccctcattaatttgaataagtgttgccatatctgactgatgaagatcttatctctgactgatataatactttgtggcatcccatgtaacttgtatactgtgtctaagaatgatcttgttacattctgtgctgtatagggatgagtcaaaggaataaaatgtgaatatttagttaactgatccaccactactaatatagtatctttactttctaattttagtaatgactcaataaaatccatactgatttcttgccagacttgtgtgggaatttacagaggttgtagtagccctgcatatggagttccatcaattttatttttaatacaaattttatattcttttactagtttctccacttgctgtttcatttctggccaataaaataattgcttaattctatggttcattcctgagtgccctcctaaagctgaagcatgcataagttctaggagcttctgtctcaactcccctgttttcccaatgtaaattctccctttgtacttaagcactctttatttataaatatatttagtatgtgattctggttctatgagtacttctgctataatttgctgagtttgttgatctccttcataactgttaactattttcaaactctatgtaggtaccactgctgtaatagcttgcatccttttttcttcaattctccatctcgataatacatctgcagctaaattttttttcccttcttatattgtatcacataatccaaccccataagctttatcatatctttttgctgtgctgcagtagttactttctgttctaataagtattttaaactttgataatctgttttaatgatgaaaggtcgggaactaatgtagtgcttccatttttctacaaccagcaaaatagttatgaattctttttcataggtagaaagtgctctgttcctctcacttagtcctttactgaggtaagctacaggtctttcttgttgtgtgaggactactccaattcaatatccactggcatctacctccaaagtgaaaggtaagaaataattcggcatagctagaactggtgccatagacattacctcttttaactttgcaaatgccttttgtgtggtttcatcccaataaaaattatcttttttaagtagctctgttaaaggtttgctaatagatccatatccttttataaaccttctatagtatcctatgagccccaaaaattctcttaaatctttcaatgtagatggtttaggccacctttgcatggctatcaccttctcagggtcaattgctacaccttctttgaaaattatatgccccagatattccacttgttgctgtccaaaaaaatatttagatctttttgcatataactgattctttcttaatatagtcaatacttcaatgagatgttccacatgctcctctaaggttttgctgtataccagaatatcatcaaaaaatactagcacaaactttctaagataaggagagaacacctcattcatggtagcttgaaatgtggctggtgcattagttaatccgaagggcatcattaaaaattcataatggcccatgtgagttccaaaagctgtcttatatacatcttctgggttcattctgatttgatggtaacctgatctcaaatctattttagagaaatattaagatccttcaagttcatccaaaagatcatcaattaaaggtatagaatattatccttcactgttaccttattgagttgcttataatccacacaaaatctctagctgttatcttttttctttaccaataatataggtgaagcatgtggactggtactaggctgaataatagtagttttaagcattttctatatttgtctttcaatctcatttttctgttcatatgtatatctgtatggtctgatattaactggattagtgcccgataacaaaggtattttgtgatcttgtggcctactgggtggcaatcttttaggctcttgaaacacatcaatgtactattttaatactttattgactaaatcaggtatctctgcctctgttctttttcaatcaaaatttttcagttgtccaactacacaacagtctcctttaagtccagatctgtaccactgtatagcaatgatcatttgaagtttggccttagtagtctttaatttagatccttctgtaatacctttcaatgtcatatgttttccttctttaataaaaataacagcattatccaaataatcgaaggctattttaccataggttcttagccaatcaattctcagaattatgctagatccatctaatctaatcacccttaaatctgtctgatactgttctccctgcatagtctatttaaaattgacatatttgagcttactcaacactttgtgtccatttgccactgttaccactaatagatttgctgcagtaattgtagccttcacttcattagccacttggtaatcaataaagctgtgagtacttcctgtgtcaattagaatgactagaattttatgaccagcttctccttgaatcttaatagtttcattttggttttgtcccattaaggcatatgcagctatttctatgtctttatcttttttttcttctgtcatggtctcttcctctatcttttcttcctcctcttcttgcaatagctgttcatcaaatatttcatcgcttctattgtggtattaacagattgattcatcttcagtgaacactgatgctccggatgatatttttctccatatttgaagcacaagccagctactcttctttgttcccactattgtttattatccttctgaaataatttctgatttctgaaggtttgagattttgtgttttccttctgtactgctagtttagtgtgaaaatattctgctgccttagttgtgggtattttgtaaatcattttgttcctttttcacatcattaacaaagcctgttcatataacttagcttgtttgtacacctcttctaaagttgtaggatgagataaatcaatatagagtatcaattcttccttcaactcactgatatagctttctataaaatacctttcggttaatactggattatattatatcatcttagctctcatatcctcaaacttttctcgatacttctccatagtacttatctgcaccaatttattaaattttttgatcaactgtttcattttttcactatcaaatcttctgttcactgcttccaccaattctttccaaccaaatttggtttatcaattaagtactcttccttctatctatgtgcctttcctatgaaatacattgtagcaattttcacccactgaactactggaatctgatatattttaaaatattgtttactcttactgctccattctctgggttcttcaccattaaaggtaggaaattccaactttggataaggtaggtgaagtggggtcctattttgaatatcacccatcctatccaatggttgataaggtgtgggtagtatttctttacctctaattttagctactactgctgatgagctatagtcaggtggctccgaactgtttgttcttccatatcttagggctgatggattgttgtttgcagtgaatgaaggagtgggttgaaaaactgatggttgcggcaaaattagcttcagcaactgctcatgcctgcgattttgttcctgcaccataatttcatacctccttgcaactttaatttgtaaagcttcatatctctgtctttcctcaatctgtattttatctaactatcttgcaaacacacccaactttgtattgtattcctcagatatttgttgtaatctattctcaatatggttgtggcagtctgtggtaaatgtttgcattctttcttccagtgctcgtaggttttcacagatatcttttaatctgattcattctaccattttttactacacttcaaaaaaaaattttaaaatctgttttgaaactgtttgacagagattaaaaatttttataaatcctaactacagcaattcaattcagagtgaccaatgatgatttcatgaggtcagattgctgttcctaacttattgaaacaataatcactcttgtagaccctaatacattcatcacaatctattctgaaaatagatctaatcaattttgagagtgttacctgatgttgagtgtcttacttgattgaatgaaaattctgctgccgatctctaacttggactgtgcagcaccacagatggccgattacagtatcaagcaagcttcactactgttttcaggtcgtcttgccacaggtccaaggttcagatctgagctctgataccaaattttgtaatatcctgactttcctagaggaattcagtgagatgtatgtgtaaatttgaagatagaattgagatgaaggaggagattaacaggaaaaggagaggtcagattgggaagggagttcagattggagaaaaaaaagttttggagagaatctgaatatttttctttgcatctcttgaatctctgtttccgattctttttatatgtagttacaagtaatgtaaatacaatattttcgaaatgaaatgtaactctaattaaatagaaatggcatttttcagggatgaaatacaaatgtaaaatgaaatgtaaatgtttctaaatgaaatgtgaaatgaaattcaagaggatattttttaggcttgtcgaagcaggttgttgggtttgatggctaaatccataacccgaacccgatagaataaaagagtttggaatcctttggatcctgtcgcttctcctgtttctttttgtcttcctctccgaaatcctagccgactcttgaccctcttttgaaaccctagccgctcccgaaggaggagaagggtgtgcccggcgtggatcaggatcttttagagtcagaccaagtctttcttgttcttttactcctctaccaataatcttgatgaggataaatatttctaactcattttattttattttattttattttatttttgctaagatgttacaaatttcattgaaggacttgaagttggaacaaaaaccactacctatcatattttcatattaaaattttggttcatcaaacataccagatattaatgggccatacccgagcttcaatgatcaatccaaaatgactcacgggtttagaaggttggttttgatcctgcatcaggccgagatttaaagctccataccgatcacagtggaagcctagactttggcacgtagacttaaaaaaaaaaacaagacattgaccaagtgtcaaccgtaggataatctagatgaaggcattctcacaacatgccatcaaatatggtaaccatgctcgagagtgccgttaaattaattatagtgcttacgaagtggctggaatttgtgtaccttggatttcttttctttcaaccatttagggtcgttgatagttccgtggtagcaagcactccatttggtctcttgtgctatttttggaaggaatcaacttgaaggacccaaaaacaaatgacgcatcggcatgacggggagaggaagccatatatgcaaatcttggcccactttagcccgtccatatcaacaccctcaaagtaaggagagtagggagacggatcctccagagatgagtgtgcttgcagaaatccatttaaatgatggaagatcttatgccggaattagggatgcaaatttatgatccactttgcaacttatttgtttgaaattggttgagatctccaaaaaaaaaaaaagggttcaaggtttggtgtaaacagaccgagcttatcagtcaatctatctggacctgtttatgaaattgattcagatttgaatctctcacctgtttaactattttagcttgcttttattaatcaatctgcctgagacctgctttaacctatttaacactaaccaaactcatctaaatatatttaatccaactcattcaatttatttataatctaatttgtttaaaatctgctttaacctatttaacttaattctacccatttttagaaagagatattttggctaatcaaaaaaataaaattggagcccgttgtcatccctagcctcaacgaacgtatcttttttgaaaagtctcaatgaacatctcttcatttttgggtttgttactatttacttgtatgacaataactatagttatctcaatgagaagaatctttactctatgcgggagcgcggattatggccgtcttgggctctctgtcgttaacaggtagagtgtgtccgcaaaattgcaggtttccatctcacccgtaccaacctctattattatgtcagttcatgtgcttctttagagactttcctctctgtgggcacaaagggggaagcataaatttccagctgccaactttttacggtatgttttggcggcacctatatgatcaataaaacaatgagaactagtccttgagggtaggccgcgaaaccataaaagggtgggttgtcccatgaaataattgaagagtggaagaatagaaagggggctgacaatgacatttttcctttctcactttaatcaatgggtgcatatttgggtcccactttaaaacatcatatatcaaaaattatatccgtaaagtttgctataaaggtcagaatcccgtgtcatttttgtcatccaaaaataaatcttaagttaggcctaacccttaagcacatgcaccccttgtttaagggaatccagtctatacgatgagttctccggcctacgaggatggaagagggtcaaatcgaacaccataggaattttctaatccagatgagaatttaaagccaataaagatagtttaaggagatgtttgattcgtaatcgaaattgaaatgaaaatgagaatcagaatgacttggaatcggaatcgaaatggtcaaatcctctgaaacgtttgattcgtgatcagaatcgaaatcgaaatcgaaatttgaatagaaatttgaattcatagagaagaataaagattgagttctatataaattaagacattttcatttcaccttggaatcgaaattggaatggaattccttccaacaaaacaattgaaatgggagtcatccattccgattttaatttcagacctccactctttccaaccaaatatcctctaaacctggacgtaacttctatgtgttacaataatcatatgaatttgccctctattctgcaaaagatggctttacctttcttttttgaccattagattaagacactgtgtttttggcgccactaaaataggttgttcacaccaatcttaaataaatatatccaaaaaaaattaaaaaataaaatatcccgcaacatcttcgagattgatataaaatcagtacacaaatgctttgaccttcaagttggcatttatgcttagcatttgcaatggagagtgattttggaattgtttggtggttgatgttcatctatcatgtattgaccaaccccatgtaaagtgttttgttgtggaagtcccatctaaagtttatttgggtaggtatgtattggatgatttatctccaaccatattgattcccccattccaatagtcaaacctacttgttttgatacagaatcaagttctcgaataagaattcatcaacaaatctattcaataaataaaaatatggaacggggggcatactttttttttttggtttggtgaggagaattatggaatacttgatatcttgcatatgaataacttaaaagccaaagggtgtctcttggcccaaaatcagttctcctgcatttaattaaagatagtgcaaatggtcgagtaatatcttcagcatatacctcatggaattgtgtactcatgaggaaactatagaataaaactgccacactctggcagctcatacatgctagcatgttgggttcactgtgtactttgtgggcttgcgaccttgcgtgcatggccaaagtgctacatatcaaaggaacaagtaacaatggcgcatatccccagcaaaaaagtcgtgtacacaataataacaggctatgcaagaaaagtgctattgagggtcaaatattaaccaccttatcagcctgggagttgtgtacggataagaaactataccaagtgcttttagacgaaagaaaaatccgaatcatgtactgctcccattgagacgaaaatctaaaactagatcgttcgaaggaattatcgaaatcactgtcaggggaaaatcacccagctgcaactagttgccaatttgctgccaagagcaatacgcttagcttcaccttcggtaactacaactggaatttttttctccaaaaataaaaagaaaattatcgcaaccccgccttatctccagactccagttctccactcaaccgctccctctaatccccagccatggcttccgcgcttcgcttcctccccctcccaaacccccgccctttccattccctcccctcccgccaaaaatctcccgccactgtcgccatccctcgctgctcttccaattcaaatcccagcggtaaccctaaccccactctagaagagaacgactcgatccccgagccaccgcccgcggccgccaccacttccttcgaggtcgagaaacgggtgaagtcggcgatcctccgggacgggcgccgggcggcgaagatcgagcggccggaaccgcccaacttcgagatcgggtggaagcggacgaaggagatcaaaacggagaagcccaagggctggatgatcgcggattttttggagaaattggagggactgatgggtcggcggcagtacgggtcggcggagatgctggcaaaggttggggggatcgtggcggagcgggcgcgggaggaggcggaggtactggtggccggcggcgaggtggaggagcggctggtgacggagctctaccgggtgctcaagctcatggagatggacctggagatggtgaaggcggccttcaaggaagagacgctcgcccagcgactcgaccaggcccaggcccgctgccgccaggccatcctcgtcgccctctccttctgatcttcgccaagttgttggaattaatgctcgtcaacacttgtttccggcccatcactactccaaatcataatgtcaaaaattttgtgttctttatgttgagaatttatatactgtaactaagatgattggtggcacggtgagatggcacatatgtggggtggcgtccgaagccatatctgactactgattagtgccattattggcatattcggattgctgtgcgcttgtaaagattcgggactgatgatttcacttgtccaacgtctaaaaaggaagtatatttaggcctagaagtattagtctggttgctgaatctacacaccgttgcaggtttatgatctagctttcaaattaggatggtaggaatggctatatcatatcgtacaatatatactgtgctactgtttaatctggtttttatattctatattctaaaggataatattatttttaacattagcttttttaaatttttagaaagggtttatgattggattatatgatatgatggctttattttatttaattaggtcatttttagcatgttttcaatcataaataatatactttatgcctgaactcaattgcgaactactttggtcaattttgatactatctccgttacaagataaatagcaaattgggatgccgatgaatctacaacatcgggtctgtgaggtttctgattgttttatgattcaactagaaagatgcaaaacaaatagtgaggagatcgtgctcatttttagaaagtttgcttgtttttggttctcaactccgaggattggaacaaaaaacggttaatatacttcagtaaaattatgaaatctagtgttctgcgataggtggcataagtagccattagcttaaaaaaattctagtagagatatatgattacaaaagttacgatgaaagtagtgataaaaatagattgattaaaattcatgtggatcaatctgaatatggatataaatttgagtatcttattaatatatgtattcatatctacgttcttaaacaaaaacaaatgcaaatatggataaacaattatcttattcatacttgaatatctgtatctacctgtgatcctatttagtcgcattcatgaatttttaagagaataaataaatatgtaaacttgttactagtttaatttatgttccatttgatgatatctttgatttaagatcataaaattttaactatccatcttatcgttgtgttgatatccatatttttattatccaatatgtatttgtttccatttaaatagatatgaatgtaagtttttacatctggttaaaatgcatatccatgtctatatttgtcaaacataaatagatacaaatatggctatgctgatatatccactggactaagggttttcttcatgaaattagaaaagttggctggagcacggttttggttgcattatggttgaatacacttcatttacaacattcctttttgtcatagatgttcgatccaagtaatcgcttgctattttgtgattgagctagaatttagcatatcggtgcagatcattctatcaactaattcttttaatgttgaatttattttccatgagctatgagaggatataaaaatggaccatcctgctggggtcattagtggatctccggaacagatattagacgcttggcctgatctatcaccacgaataagctatggctaattttggttcatgccacctaggttgggacatcctcctgcccgagcccagcctagaaaatacccaaaaaaaattttggggtcgtgcctgaaccccaaatggcctgaaactgcttggtccaaaaatatttagatccgttgcgcagatatacgagctcatgacattattatatgctttgagaaagctaacacataggatttatttgatttgcaagaatttttttaaaaaaattatttttaaaaattatttttaaaaaaaatattttttgaaaataatattttagtatgtttgattgtcgcgaaaaagtgacttattatagggtacttatgtttggttaaacatctattttgttagaaaaaattataaaaaatatctattatatctctagtagatataaaatcatatatttttcttcttaaattttatataaatataaatattatattaatattaatataaatataatattgatatattataatataacataagatcataataatttattatattaatataatacaaatatattaatataatattcatatttaatataataaatttattaatatagatataaatataatattgtattaatataaatatcaatatattaatataaatattatattaataaaaaatattatattagtgtaaatattaaaataatattaaaatataataaatattataatattaatattatattcatataaatattaagataatactaatataatattatatcactattcaatattttatcttaaccatctattgatattttgaaaaatcttgaccattgatctcagaagaatattttagaaaagaaaaataccatcacttcccatcctatggaaagtgccaacatccatctttcttacaaatttttattttttataaaatataaaaaataacttttcatgaaaataactttttctactctctctttttaaaatttcaatcaaacaaaaactctctttctgcttcttagaaattatatctttcttccttcactttccaacaaccaaacgagtccataatatatacacacacagcagatatcagatggctcaagttcattgccaatctacagttagcctcggggcaggtgtgcgagctggattaattcttaactcgagtcccggcagctcgaccagcctgagtccctttaagcattatattccccaagactctttctaatgccttgtttgccccgggctcaaaggggcctcgctacaaagtgcaagttttgaataacccaaattatcaatttatgactgatccaacttgagaagatgacttgatttgagtgactataattcgagtcatataattttcttagtctttctttttttctttggacagaaataatatgtttgtgtatttttaattaattatcttattgcgaaaacaaaagcattatttaatgcattactgatgaaaagtcatgcttagcaatgttttctttagctagaacgttttacctgttgtgctgtaatgctaggaagaccagaaaaaattgactagaatgatagttttaggaaaaaaaaaaaaattgaaagcgatgcaaaacccacctagaagatggatttggaactaaccagggtccagtccttcaaattaaacaagagtctctttttcttaggaccctaacaattgtaatctggatcaggttaaaaacaaacgcgaacctgtaaacaaaaaaacaaaaaacaaagaaaaacaaacactaatcaaatttcatcttgagctaaatttatgtcaattagtttaggctggatggtatcacttgagtcaagtgacggcagaatgaataggaatttttaagataagaaaaatgtttggaatatgctggattgatgtttgttagatcaaggcctcaacagttcaccaatttcgatgatacacatgcatcacttgacaagactaaattaattatatatatatatatatatataaatatataatatagtatgtgaattgaaaataaatatataaattaattactagtttttatttataaattaaattgatttagtttggattgagttaaaggtcaaccgtagttcagctcaagtttataaaaaatctcaacccagtcctattgaagaagtagattgagagggcatacgactgctagtggattataacccccttcctatccgaaacaagtccaaaattattccagtccaacctaaatcaaaattatttggactagactcggattcaagagcatgacctattctcaatataaagtagatttggatcttaaattcctaaccatactcaaaactctttttggatataagacattagccttctcttcatgatgtagtgtcaataatttatattgttatattataatcatgttatcaatcaaatcttatacaaaacatatttttgataatgtttacatgttactatctatcattgtattgcataatacattcataatataattaactaatcaatatatatgtttaaaataatttgtgtttggattatttttgaccccatgtgactaggaaaaatctgatggattgaacatgagtgttaaatctcatccgatccaacctaaagagaattggactgggtttgaattcaattttttttgattttattaaatatgaatctgactaggttgtgcctatccctcatccccgacttgcttgtagtcttagaatggcaggttcggatcaaccgcaacctagcttgaatccctgcatatacctaacaaaacttgtgaaaccttctatatatatatatatatatatattttaattaacctaaaaccttttataaaaaattgacaccattcattccccttcagtagatgcagaaccacgtgcttgatggtggcccccattgtaaacaaaagtttttgggcgctaagcgtggtgttccacggtggttcgtcggcttcaacggtacttcagcgtcggttcattcgagcgttcaccaatcccaattttatgtcaatttgctttgaggcgaatcttcttgattgttcttcaaagaaatccgcgtctgacgttgcttctggggaaaacatttctcatgctggcatccaattaaaaaatagaatcaataaacgagagtttaatctgtgggcggtttgaaaacaaacaatgtccggatataaaagggggcctcttttgttcttcactttctatcttaaatcctacatccatggtgcttaatagttggggtgttgctttcagctctataacattcgtgatccatatttctgagttattactctggcagagttaattgtgggagcataaacgaatactgagtaccggaaaaggggaaagggagagggcaagaagatataaattatctaaatattacattttttatctataaaataaattaacagataattgatgttttttttatgtaagaattatttttatgtttagaatttatttatatgattgaactgaaaattttatagaatttatggatttaatcagtacaatcaataaaatcacagacatgataagctaggtttatatgtataaatactcaagataattttgaaggggactgctctgaatctcatagaaaaaaaaatgtgctaatttttgttggcccatttcaaaattatttttagatatttaagaatataattataatctaatttataatcttataattttactagttatattaatttaatttatatattatataaaatttttaatttaatcatttaaataatttttaatttttgttggtcggctgttcctgcttataaaaaatatattttttatcttttaagcaatacggtggatcgctgccccaattcgtggcataaagtatctgtttgcagctgcaattaataacgttgcatttttcttattcttcgtatgtcctcccttcgggagtggagcggtcaatcactaaggttgcaattggttgataacttgatgtcgaccgtacacacaaacacacacacacacacacacataacccaatatatctataaaacaaatcttatagccaatccaacccaatcacatcaggtctgaattcaaagttgacacacattagaaaaacccaaaccaagtttaatcaagctaatttctagaaggttcttttgttggtaatactctagaaggtttttttttaacatctaactttcccacctattgaaacaaaaaatgtgactgatgaccaatatgaatagaaaatgtgattatttattagcatcaaatttcatacacttcataagttgcaaacctgccccccccccaaaaaaaaaaaaaaaaagtagcacacgtannnnnnnnnnnnnnnnnnnntgaccaataatgaatagaaaaatagtgattatttatttagtcaatcaaatttactatacaacttcataaagtttaggcaaacctagccccccccaaaaaaaccaaaaaaaaaaaaagttgcacacgtatggggggggggtctatgttttgactcatgttggcatgtatgtcttaatttttttttaaaaaaaatataaatttgtataatttttttttctaccaaatctattgcatcatatcaaatatgatatggtggaattggatttaatgtatttcattaaaaataaaaaaattaagatttagatctattcgaatgattgagcttcaaattctataagattcatgatttgagctgctagaaaaaattaatctaaactaaacttatattattagatatcttaaacttaaagtttttagaatggaccggtccaaatcctatagagagaaacaaacaccttagcctgtttttctccttatagaattcgggccggcctactctaaaggctcgtgggtattttgaaatgagaaattctttatgcaccgcaggcagtgcagaactgtacgcaccatccacagtgattggttcacatacgggatcgaaagaaaatttttttttcacacgctgtatgccggccccgcatgtgagccaatcaccacggacggtgcctgcgttttgcaccgcccacagtgcacaaagaatttctcttttgaaatataaagctagtccaaagccatttttttctaattaaactagttcacctcatgaatcttatgggatttttggtctattcatccgaacaaactctaaaaggcagatgcacatggaaggatcatacaatcatttttttttgttcatctgcatgaaaactatgtgatcatggatgcatgatattagcattatgaagcaagttggtatcaacatatatcatttgcaacgaccgactcgccgatcacggtccagtgcaaggtcgaggtggctccatctccttctcacaatccttcgaaaaacaatcgccaatccctccctcgctgcaatgcgcagtggtgtctccctctcgaggtttgtcatatgcaccactatctcgaagtcagctggccaattcatggtataaccggccagcaacttcactatctcgacgtactccgcccttgacgcaatgttgcaatggggtctcccccaccgcatttttgttaggttttcacatgatttgaggattttcctggacaaaatgtttgtggcctagccatccgaggagcgcagtattgtcttggtgagtcaaagatttgacaacccaaaaaaatcgtaatcaacaaatcataacattaaagactcttccatgcatcgtgcatgctcactaatggtaaatttctgattcagaatttacaacaaacgcgtggatacctgacaccaaatcatgaaggtcccaatcaaataaaagagatgatccaaattttcaacaactactaccagtttagatgcttaaatacatattgtaggctgggtatgattcaaaaacaaccttcaaaggacaaataaagttacaaagaattatatatatagattcatgaccatacaaaagacactctcgatgttttcacagaaaattgtaactacagtgggcctcggaaccagtccaacagatcacaggaacgggagcaaccctaggcccagcaagcccaaaaacaggcaggaaggaacgtcgaccccaagttcatgaggctcccatcaaaatactacaatacaatgatctctacaaactcccctgcatcaaaagcaatcaaatctcctcacagtgggatgaagagaacatctttgcccagtatggccagaacaagtattggagcgctgcaaccaatgaacatcaccacaatagccaaccaaaggctctcctcatggaccaccaggtacactgctgacatcaacgtcacgatcatcgccaagcatgcaaccacagtgagcctatggccccaagccagctgattgagtttgaaccgaactgggtccttccatgcccatatgaagcagaacacaaccacaatggagctacacatggccacagtgttggagatcacgaagaccttgaaggctgcctgattcccaagtatggcgaaaccgtatgtttgatggaaacctcccggaatggtgaaggtggcagcgaaggtgacagttgcgatgagtgcggccaccaaagtataggtctctatacttaatttgtagtgctcatcggcctttgacatcttctttctgaggggatgagacatgcttacggtgtcattccattgtttcttgtgtacttttgcttcgtgcttcttcaatttcttccaaatgtacaactggttgaagtgcaacggttcagtattgattaaagttaggctattatctttttgagttctttttttttttttttccttaaaaaggttaccatgatatcaacaatttagtactatggaaacatgaaatgaaaatatatgtagtctaatgtttagtcggtgcaatgtctaagtcgccttattagcagcaactctgacattcactgtatcttttcatcgtttgaataaattccgggtggtcttcgcacctcccttcagcccaaaaaaaaaaactttagtgggtgcaagttcaatggggagtgcgttcgcagcaatctttgctgctgaatcgcagaagtacagatcattatgccttcatatgcaatggactcttcccagtccaagttgaagaaaatcataaattttgataggcaatggaagaatctagaaaagtctccctttttctttttttcaaacatcgtcctcggtaaattgggtgtggattaaagtagcatgacaataaaaagtattggctatgtacacggattgtaaaagatgttctataattagaactctcaaggatttactattatgatgtggtgaatccaatttgacccataggtttgcatttcacagaaaggaaaaaaatatatttttgattagctatgacatggatatatgcttgtgttcccgtgatatgaacatatatggtatcttaacgcatctcaaaacgtgatcttaattaacttacggtagtttgtgaaggtatgttgcttttagttagcttatcgttacagatgccaaacatgctaggttaattcagcatacacatgtattaaatgtagttgctaaagtttttgcatttagaataatttaactaaaatctaaattgtaaagctggagatctggcaataattagtttataattatctttcttctatcattatatttattgtgattctaataatatggagggtatcaatagttccatattggttctgagtcaagggagaacttacgcttataaggaggaaaaaatcttttccacgtgaggcatcttttaaaagataaaattgtgaagcctatagatcagagcgaataatattttacatcacagactaagtccttatccataacaatggtgaggagatatacatatcggagtcctctttgattggagaattctgttgtggttctaataatataaaggacaccaatagtccaatatcgattgtgagtcaatgaggactcatgcttataaggagaaaatttttttttccacgtaagatacattttaaaagataaaatcgtgagatctatagattaaaatgaataatatctcatcttttgattaattttttggagtcccctgtaggttagaacatttgctcaacctttcaaaagagatatctaattaagattattaaaaaaatatttaatatttttaatataataatctgattgcagaaattgacaaattggaaatggaccctttttttcaaacttcacacacaaacacacacacgcacgcacacaaaagaaaagggtctgggcctcggatccctacctcatatgtgtccagcctttccagagattcaaccaaatttcttgcagtgagtccatcattattcttgatgcttggatccactcttttgtctttcatgagcaagatagacgactgtatcctagaatgctttgcagccagatgaagaggagtgttcccgtctttgtcaccttggttgattatctcatcaaacgccatggtcttcaataggcacttcagtgcgttgaaccttccgctcatgacggcaacatgaagagcattcatgccctcagaatcaacctgctctattgtgaccggacaacatttcaacagctctttgattgcgtgagtagaaccatagtcggcggctgtgtgcaggggagacctcttcatagagtttatggcatagacgagcgaaggtttttccttcagcagcatctctacgatcttggcattgtccttttgcgcagcataatgaagagcattatccccgtagctatccgtaacttcgagtaagtcgctccgtttgctcaacaacgtctccacaatgcctgtcaggaattaatgtacgtagtttagttgtaaaaaggacagtccaccgatcaaacatgtggccaaagaccccagaatgcataaaattatgtagttggtgaaggcgtcaatgaaggatatatatatatatatgtgtgtgtgttcggagcaaagcaataagaacttactatcatggccaccgagcacggcctggtgcagaggtgaccccgtcccagcctccagctccatctcctccatggtttctacccatggttgctgcaaaatctcgtttacaatgctcaccaacccctccctcgctgcaatgtggagaggcgactccttcatagagttgagaatatggccagccggtggatcagcacccaacagcttcaacgcgacctcaatgttccggtgcttcactgcctcatgcaacgcggtgttacctcttccattggccaaccttaatggctccaatgccaaccttatatcggctggccatttggaggcataatcgatcagcaacgacacgatttccaggtgcccagcccttgctgcaatatgcaagggggtgtcgccctcggcgttttcgacgatgatgaggctactgcgtttctctaggatctccgcggccaaatctctgcgtcctaattttgctaccagatggagtgctgtgttgccttggggagttgaagactggagaatcttctcgtccttttcgaccatttctctcaaaccccgaacgtttccctgtgtcactgccatgtacagtccaagatccatacttggtgccgttgagttgtggtgcttctccctctctccacaatggggaaagtggaggatgcaggaattgacgcctatcactggaggacttgaaactttaatgaaagttttcaaacttcttaaataatgcgtttgatataaggcctatgcgggccggagcttagatcaggaaaatataaggcctatgcctggctttccttgtagtggaaacttcaaatgacttctcggaatttacatccagaaaacagcttcttccttttttttttttgactgaaaacatccagaaaacagcttcacagaacttgctctgcgattaagcgatcaactcggcgattatcatcgctccacacattttaaaggcaaggaagcgaggagccaatataaattttcttataaaaagaaagaagaaaaagcattagtgtaacataccacactatgacaaatcagatgaagtcgcttatccactaaaacaaagaaacaaaaatctaaaaaaaaggagatagagttcgtactctttggtggtaaaagaatcgcccaaaattacgaggtccttgtttcaaaaataattaagtctttcctaggggagagatatttagtgtgctcttaaatcaacgattgcttcgctgtttgtctatagtcaatttgttttgatggtaattgtctataattctcttgaaaaaatgataattgtatatattcaaaataaagagaccaaatattctagtaaacgaagagggtaatgtatgtatatgtggagagcaactaactcaccttgcccaaaaagtggtgtcagagcgtctcaatcaggacgttgagctgaacatcgatatctgaaatgtatgcccacgagtagaactgaagcaagaataggtgatgagttgatctcgtctcaaaaatgattatacgctagtttacttgaaggcgccatttattgttgtagattgtcgtagttctgtaacttaattggtgctttgcttggattccatgcctcgaatgctactttaccacgcgcagaatggaatatggagtgccttggcccttgggcattccatccacgccatagctgacataacgtccgttgcaagccagttgtgggggtccagggatttttctatgttttgaaaactagggtccttaattaagccttttcctgattttaaagctaataaagcggaaatgatcaaccatgtcctctccggaggcatggttttttttctttttttttttgagtgcgacacgacaagcttcgttccggttgggggggggggggcggccgggggcgggcggtgttggaatgtaggaaactgttgctttgatttctcccttccaaacagtagtagatgaattcaccatctggaggcgaaaatcctaagagtataaacggagagctacagtagcgctctcctttctctctccgaaaaaaaaatattcgttgcaatgatgatattatcgacatgtttgatcaaattataaaaattaatttattttgagatgactattttttaaataaaatttcaaaaaaaaatacggtgagaaaaaaataatttatatttaataaaattatttaataaatatttttatcaatatttgagaagtaatttgtatttgacaaatttttttttaaaaaaaaatttgactgtcaaattacaaaaagaatatgtatagatttactttacaattaatattatttaaatagataaataattttaaatatttattatggttaattttaattaaatttttatttttatttaattaaaatataaaaaataaaaaaataaaaaaatatattaaaaattttaatcaatataaatataattgaatcaaagataatacatattaaacattttatataattcttatatgataatatacacgtatcaaaatacatcattcactaaatatgaaaaatttatcccaaaaaagaaggagaataactcatacatgaaaataaataggggtggttatggaaaataatgattttgagtaaggatatttttgttttgaaaaaattaattttctacttctgttttcaagaagaagctccaattttctgcttcctctttatagcagaaaaatgcatctgctaccactcagaactaaattattttttaaaataaccttggccaaacatcctattttttttaaaataagtatttttttgaaaaataagcagttttttcctcccaaaagcttggccaaacaacccctatgtcaaatttgtaacaaaccaatgaaagcctttacattttattgattgccatatatttcatcgatttccatgaataataccccatactaccctccagtatttcactctttcctgactgttgattggttttgttacaatagtgacgtgtaatcaccattgcaatgaaaatttactcctctctccgatgaaagtgcgattcttcttctttgcgtatttttcttggaaccgctttcggctattgcaatactagagacttttttttatagaaacacgggaggtttacccacctattattttattagaaaagattgaagtattgccacaagacaaactcatcacttaggttgatcatataatacgactacataaatcttaaagcggtatagagattatataaaatctataaaattataaaattataaataatattagaataattatattaatcataagatttaactaaataaatccatcattatcgaatatcaaagtttacaaaattcaagtatccatttagtatcaaaaaaattaattctacaattccaacactcaaaatccaagcttgatccatccgatactaagcattctatgattttgaaagaaaaaaacaaaaagatggcatgagcttcatagtcgagtaagaatccccatacattaaagtcagaccgactctcgggatgcattcatagtctgtgtcagacgaaaggtggccccatccagcatatgaggtattgtatgctttggatgtctccataggatccctacacggttttgtccccatgggccactttgcaggccaaaaggcacctcacaaggggctggagggtttcgaagccttataaggtgaggtggcctgattgaatagccgatgtgggactaaagagtccgctccccctccgcaacagtggtcccctcagtcagaggaccgaacctgttatggagaggcctgtatgggccactagtgttgcggtccggtcagccaggctcataaggtcggatcggctctcgagatgcgcccatagcccatgtcggacgtaagatggccccacccagtatgtgaggtattgtccactttgaacgtccccgtaggatccccgtacgattttgtccttatgggtcgctttgcgggccaaaaggcacctcataagagactggagggtttcaaagtcttataaggtgaggtgcctgactgaatagttgatgtgggactaaagagtccacctctctccacaacaattatcattcaaaaatagtaattaataatatcaaaatgaaaacataaattataaaatctcatattaaacatctagtatatcctaaatcattatatatgtatataacatatattttgtatcatcataaatctatcacaaatattatcaacagtttcatataacttattatctaggactgccaaaatataacccgatcagtcataaacatgtttggttgagactaaacagacttggatcataaatagatcgatccgtttaatatttggatcggatttggattttaaatatctgacctgtttaatccatttaattcatttaatatttagattgaattgagtcagataatctatttaatctatttaacctatttctgatctatttaatctaatttgtttaatctgtttgatctgtttaaaacctacttaacttatttttgatccatttaatccaacctgtttaacctgtttaacgtatttaacctaatttaatttgtttaataaacagattaaacgggttagatcggattatctgtttaataaacagacagagttcagatttgaatttttgatctatttaataaacagatcatgtttgggttgataattttttgacttgaccgatatccaatccgatccgatttgacccaattgccacacctattattatccatgtttcattagcaaaatctaaacccatgaacaaatattttcgattttagactaactatgatcatgcttcaatctatgactgtcaaatcataatatccgtacttcagctcgtagtagtaaatcaagatatctgcgctttggatcttggtggcaaactaaggtatccatgcttcggcatatggtaccaaattaggttgtcatgatttgatccatgattagcaatctaaagcatcatgattcaatctgattgataatccatatcatggctagttcaaaattttttacataataatcaaatcatacaaaatagttgacatctcattctcagcaattattatgtgatacataaatgcaataaagatcatatatttactatattcgtatcagcaatcatatgacaaacaatagtcatttggtacaaattcaaaaaccatcatatataatataaaaatatatatacatatatacatacaggtgatcacatagaatgttttttatctttgtcaatcttagactcaaatacaataaatatcgatctatttctcgatctacaaattcaaaaataagatattctgctcgatatattcttattacagttacttctctatataatcaaatttgaatataaaaatcatagacagtaaaaaaattatagtagatagctgtagtacaataggtctagtatcccttgtagggtcaattagttgatttaggtttatctaagtatctggatctttcattaattcacaggatatctagagagagaaaaagagaaagtggagagaaaaaaatagataaagaggagagagaaagaaagtggaaaacaaagagagtcaaaatattctttttttttccctctctctctttttcttcttcatgaaaaaattgggggaagggctttggaccggccatccccatagcagcgaccctcgatggtgatctccagcaattgcagtcatgacaacctagcggtagatggcaataatagcgaccctcaacaacgacagccaatctgatagaagaagaaagaagaaaagaacaaggaagatcttgatcatgaaaattcggcaacccactgacttcaaacaagacgacgatgatcacattgaacctaaaaaaaaaagaaagaaaaagaagatttaaagtcatacgtcatctctaatgaggtatttggttcacttttcatgtgcaaatggaaggtggcttattggaaatacttgatagaaaatcaaaaaaatcatacggattttaccagcgatttaattgggaattaggttgatatgtttagaagaagatctattgatagctgagatctaaagctccgacaaatcatagactctcaatcttcatcgaacgcgagaaggaagatactttccatcaggagtctttctccccagccgcacctatcaggcaaatacttagcagcccaagtggccggttcagtctgcctcaacttgggtccggcctaaaataaaacgcgcttctataggtatgtaccgtgggcgtacgtacaacaatgtggtccgaagcctctgttccagtgaaaagttcaaagtggacgctgtcgagcatgcaacgtgacctctcgacgcgtagctctcgcgcgccggttcgaagaacccacgctacgtggatgcttctcatactgttcaaaaaataacagttacggtgcttcgccgttatatttataaaaaattcaaagccctattccatcctatgttaatcgagatcgacgaaatcacggccgtccattttttttcttttgaggattacggcatcccacgatggcacgatctcagttgcttgggtccaagcaaggtcttgtttgacgcttcatggtgaccggtatctcataaagtccaagatcgcggactcccatataaaacccccgtccgaccctctcaccgcgcgacgcacttctctgatctttcccttcgtcgtctccgctcaccgaacccggctacttccacccgttgtctcctcctttcttcctctccgccaccgcttatccgctccggcttccaccgcccgtccacgtccacccgttctcccctgatcgccgcccaccgctggcctccctgtgcccggcggagtatgcagcatctccggcagcctccaaacccagcgagggcacatctaccaccggacaccttgtgccaccgctacaacctcccggtacattcccaccctctttcttgaaaatcttgaatctggaatcttgataaatcttgaaccttgatgaatgttgattcccttcctgccttcttattctatgtttaagcttctgcgtttgatcattaaggtattctttgtatataacgccagagaaacattcccctcgtgcatgtattgttaatttggacttattacatgatctaaggtgtggttttatttattttccctcaattagtggagggtttttatttctaatgcaggaaatcgaatcagatggatgatctaatgggagttcacatgctgtacacgcatagtgtgctggaattttgagactgtcgtggatggaggatgttgaatccttgtttcccattctctttccctagaattaacccatctgggtttaaaatttaactttaaaccttcttggtgaaaattcaggtcaagatgcttgacctgaagttgactcttgaccctaatattgaaatctacctgactcaagcccaagtgaaagtgattgtcattttttactatattctttttttgtgaggtaatatttatatatattattattttaattcaacatttaaattgtaatttaacaatatatttgctgatagcctcaactataaattgatgaccagctggtcaattttttggcccaaagtaatcttaggaccgagtgttaaatttaagtcaataaaaatgtccatcttggcaacacttgttagcatcactatcagcaattgaaacttgttttggtcagagttaatttgaatcatgtttctttttcaaattcttggccaacacttacatatgggtcaaatagcgtatgcatgggcaactcgagccaatatttctcaaaatcttcatctccatgaatcaaacagcatttgttaatattaaaaatgaactcttgttacttatagggagatttggaggtatgaaggtgttggattctaaagagtttccgaggaaaagtaaaagtttgacataggcctgcctagattatcatcaattaataaaatggtaatttgtattctaaaatgatgttaaccatatctgctcatttttcataaaaatatatatttcttattttgctggcatgatatttccaaaatgcttgacccaaaggccccaaacatacaaacaaataatacaagttaccataaaagtatacctaatcaattttgcttgttctttaaaaacactcttttcttttgatattttatttttcattattctcaagcaaactagcttggccaggccaaaattgaaaaccatttttctgaaccttgattggctaagtggctaacatgttctgcctaatgattaaattttcacataaaattattttaattacattggaaaattggattattgttatcatattattttcttggaccatcaggaaaatatatgtcgataaactaatgtgagcttgaaacatttcaatcctttgtcacaacagttgtagaagagaggagataagcaatagctcgtggaagcgatctgagcttgtattcttcattgtctatgcttgggcttttgattgtttattcatctgtcggtctctgcaactcttccgtggtaatcttcttagttctttgattcccttattctggtacatcctctatgttgtctttgcttgtatttttattgatttaagtcagcttcagccacctaattattgtacatatcattctaaaaaagcctctatggtttatgcttgggatggatacttaattgcctttgatcgtatttttaaaggtgttatttttcctgattctgaatgtagtaatttgtgggtgtgattttgttttccaaaatattagcaagtgctatctttgtgaatcatgtaaagtttgggaaatgattcataagttagtcaaataatgaggcaaagtttaaatcctcaggttgcttatttcaaatgtctgacagtcctatgggagaaatgtagcattttaagcttattttttgtgtttttgttgtggaaatatggcttggagattgcattgttttgtacaggtatttactactaatatacttatctggaagggcagaacaatattaagtagtggctggtggcgtttcaaagtatatttgcctatgctgagatctctgttacagtaacaattgttcagaggtgtggtagtcttgcttgaggaatgggtgcagtgaagatgttattactagtttttttgagcctgatccttcctagttgttttgagactctataactattcactgtatcatttagataagcttcgatgttggctgtagaggggaaggtgctctcagcaattttagatgatggtgtcctttgactggtcaaaggagtttgtttcaaggtggttggggttctagtaaccactccaatttcgacttgaagtctgccttgatcagtactgctccaagtgactgggagaataaagaccagtaggaaagaattgcttttgctattttgacttgagagtggtttctagtggaggatgataggtcatgcgaagcatgattgcagtttgtggatggtgaagtctctgtcataacaatttatattggaagataagtcaaactattcaatgaatatttgttaaatgatggcctaataaaggaaaccgagttttaatttttgttctaatatggattttaaggtagaagttgagaggattaaagaataataagaaaaaaaaaaatcaaatagtccttgcataggtaaaggattcaggttatgtgcttttcatgagctaaattagagacgtgtagtggatagttagtgaaagctactttgcattcctgacacatgttagaaacaaatcaaggaacatttttccatgaatttatcatcatattctatttgaaacttctgggtctacgagccctgatgccaaatttacatgctctgatgcaatattgatgccaaataagaatttcaatataaagaggaatcctacatgcaagatccacataaagttgaatgcagagttgattaaaatcagtaccctgaacatcagtttattaagtttgtgatgatcgtagttggtctagaacttcttccaaaccaagccttgggactctatggcccaatcagtgagattgcgctaaagccttgcaaaaaaaatttagtgcttggtcccttgtatacttctttacttatctttttccccttggtgtgcagaattacagtgcttggtcccttgcaaggaatgtcgtaccgggtcgaaccacccggtacgggacgtgccgaaccgtcccggcggagaaccgagacggttccgacatgcaaaacggcacatgctggtgccggggaagaaaaagagagaaagagagagaaatagagagagagagggaaggaggaagaaaaagagggaggaaaatccgtcggaggggccgccggaggtcacccgtggccgtcggacggcggaannnnnnnnnnnnnnnnnnnnaaaagccttttcaaagtgaagtcggcatggattttgccggcttcactaaggattttgccgacttcactttgaaaaggcttttttaaaaaaaagccccgagaaacaggagcggatcgcctctgttccccgcgcggagccgcgggagctctttccgccgtccgacggtcacgattgccctccgacggcccctccggcagattctcctccctctttttcttcctcccttcctctctcactctatttctctccctctctctttttcttccccagttcgtccgtgttttccttcgtcggttcgcctcggttcggaatggaacagaggcgtgccgtaccgtaccgccggccggccgatccggccatcggtaccggttccgccaatcttggtcccttgtctacttctctacttatctttttccccttggtgtgtagctgatgtagatcgatgataatttacagatctgattaaggtttaaatttgtcatatagcagcaagtccacaattcatggttaggttggggatctcgccttccagaggcaaattctcaaacttcaggctgaattaattatgtgaatcaagaagtagacacttcattggatgctagtgcttctcccaaaatccaatggttgcaatagaagatttaagatgaaatcaacaaataggaagggagagatgaagagaccaatggtttagccagtaagacagctgacttcttccttcctcaccccccctctctttcttttctccctccatgtactttgggtaaaagggctattggttctgctgtttggctggaaaaataagccatacacctctgattccttaaattgaggtattttgtcccttaatgatgcagccattggcttgcttgatacctataatttttcagctaccaactaattaaagtagggctaaattaagcacaggtgagtacttgtcagccgaaattcaactgtttaacaattcttactttacgagttgtatggctggctgatgttccacctctccataactagtgcattgtatccttgttccttgcctttgcaataatggatatggaactcttttatccccttgtttgatacttgaatttagttctcttcaaaggtaaaaagttatatgtttgttttcttatgggtcctttttttggtaggatttttcagatacactgtggagaaactttcgtggaacctacctatccttacctttatgatgtttcttttctgtaaattgtggcagatttctttaggtaccattgttgcttaaaagggagaggaatgttagtcaaatagattttactatctttgtgttacttattatattgttaggaagcttggtatgtgtcttgattatgagatttctaatttgatagtgttgtacgattattattcttgtttaactagtctctgaccactatagtgttgtgtttgttttttcaattgctttggtgaattatctcatagtgaaggtccatgctttggcttaataccaaagtcttataattctactcaaaatttaaccatgcatattgataatagttaaattttattatggccctgtttggcaaagcttggagtgtcagaaagcactttctgattctccaaaagtactttttgatgattcaatggtgttcgataaataatcgaaaagtcattttggctttgttagaaagccgaaaaggtctatttgagaaaagcttcattttggagcttttctccaaaaatactttttgaccaatattgggaagctgttttgatttaaataattttttttaatgacataaatgcccatctacaaatctcataattacgtcttatatcatatcatatcattattattatactataaatataatataataataaattaatattatgatatattataaacatataatacaatctattatagtattattatataataaaaatataatctaatataataatatttaataataatattatataattatattatattaaactatattatattatattattacatcatatgataataatattatacaatataataatattttaaaatatgataatatttatattataaacatataatataatatgttatagtattattatattataataataatgcaatcaaatataataatattttaacaataatataattaatctattattttataatccattattagattagattattatataaaatataatattttattattttattaagatgtattacattatatgataataatattatataatatggtaatattttaatatataatattatattgtattattctctactatacaataatatgtaatatcttttatcgtcattttatcatactaaaagcactttcttattttaattatcaaacatatatagtttcaaagtattttataaatatggtaccaaacagtaaacaattttttatgaaagctctacttctcgaaagctctacttccaaaagcttcaaagcaattcctagcatggcctacatatatttgcagttttttttttttttagattgcgaagttaccatgtatctaaggatggaaatgaccccaatttataacataatccactaatatgagtttgtgtgagtttatttttattgcaactcgtcaacacaaggaaatcctatttgcgctgattaccttattttagtattaacattggctcattttttgttatgatatgcactaaaaattttaaacaaatgagacattttgtttagctatctgacatcttgatgccacttaaatgattttcttagtgctggtcaaaaaagggatgtagactttgggaggattttgagaggtttatgaaattaaatctaatattcaaatgcataaacacattatttaagtgaactattgaaagttctgcacttattaaagcacatgatattatttgttctgcatgttgtgatatagaggtttttatgctcatacctcatagggtttttggtttgagtaactagatgtgaaaatatggagcattgctgggtttggggccaatggatgagattttgggtgctcagaatgaaaaaaaaaaaaagaagcatatataacatggtaacatgcagttttattatttattatttttatcttttgtttgggggcggggggagctaggttctggttaggggagttgtattatggacaaatactagaatatgttgcatgatatgatcatatctgcattatcccagtaaacactgctgtctcatgtaacaaaatggtatttgggaaggtgggatttatttgaagttgcaactttagtctgcccttgcctgtgctgaattattgcattttatccgaaataatgtgtgtatatatagattatttacatgtatatcaatatgtatatctaaatactcgtatgcaggtgtgcacctgtttgtttacttctcaatgaccgatgatattattataggcattaatcttttacttgacatgttgcagaagttagaaatcagcttgaacatattttcttttattaaaagtttaaatctacaattgttttcattgcttttggatatagaaacatatgcattgctgccgtgtgtgtcattctggcaaggcatgctaccatgttttataggtatttgaatgtttacatgcttccaccaactaacatctgttatttccaaaacattatgataaataatgttttgagtttctttagtggcattataagttattattcaacttagaagtctaaaagcataagacgtcatctcctcaaccaaggttttaaatggtggttcagtttgggtcccttgggtagaattttgtttgggcaattttgccagtttcaattgaggttttagatatctggctaaaagaagttaggaatatttaaaatttaaaatttaaaaataaaaataagaaaatttatttcacctctttctatttttattttcatcatcttggatcatgatcattggagcttaatttattaaatgtgttacacttttttcaactttttataattcccctatagtttcctctattttttgtaattttctcatatatactctaatttttgcatttaatttaacttgtctcttagtatattttcttctctttcacattaataatctatatttgaaagaaaagtcctgtataagcatatttcattctatttagttcttataactttataaccatctatgaaaaggaaaaaacccatctaaacatgttattctactttattttgatattccatataggcaaaaaaaaaatctgagcatatttcgttctatttcataagaaaaatcctaaccaagaaattttatgtaagtaaaaaaccattttttttattgtttcatttcaatatttcattttatatccatagaaagagacaagaagctcatctatgcaaggacaaacatgtaatgctttctaattagcaaagacatgtatcaacattgcagctttggtattcagtaatatattttcatctaccttgtctatgataaaagaagatatggttctgttcattcatttactctgttgcataaaatggataaatcctgatatgattctacccttactgtgtagctgtctgtgaaatgcttaaacatacaatagtttattatggcgcattgaattaagacctttcttccataactatggaagttatttgatgattttgttcatcagggaatcttctcgtgagcattgagatcctcttattgactcgaggattaaaaggaactaggaaggatagagaatttggaaccaagtttaacaaaagaaagaaactcatgagtcaaaccagaataccaggtagtttgtcttctcctgaaaggattagaagtatttatggagtcaatctctagcaagttaacaagtgtttagaagacaagtcattattatttgcacacacagaggaagtcatatattatataatgaaactatttggggtgattttaatctcgatgaattgcttgtaactgatgtacttaagtattaactttcattatgctactttctgacttttacttatatctagaataggtcatgcaccaatgcccctatgtgctctgattttgtaggatacttcagaatgaggtcccaatttagaaagagactatccaggtattctataaagcaaatctgacagagtctgctatcttgtcaaatttttgctatctttaactaaatagacttaatatatacaagaattgaatttacttgtgcggaactgaaaatttagttataagacaataatgtccttgacttaggttcttaggttttaactttttaatgtgacttttcgcttctttttatggttaactatgtcatttctgccataatcaatagtaaaatattcctaggttcatatgtaatttatcatttaattattatttttctgcaataaacgtatgcaaactcactagctttgattactagcatacgttcaaaatacttatatgcccatatacatagctgcgctggtgaagccttttttgtgaatatgaagattccaagataactaccttcacatccacatgtggggttcgagccttggatattcatttttcttcttttgttatctttcccctgtactattgctttctgactgataagtccctatacctatcacttgtggaaaacagcaattggaaaatgaacaagataagaatgtaagagattatggaggattgaaggtttagttctgaaagctaaggggctaggcaaaagagattaatgttgtggaaaattgaaggttaagttctgaaacattatttgctttatatattgtccacatcctcttgaatttctttatgttattttactttgagttgtattatagcttgataatctcatacccataatcataatcgtctagccttttccaaaatatttggtattagttttatggatcctcatttgttaatgtcacctctgatgttagtccaagtttttctgtatccttcctcataacctttatccatataaattttggtcttgattttcctttcttacaaccttcactacaaattaaaatctctctccttacaggagccttcttagattgtcattgtccatgtccataccatgtctttaatctatgtagctcctaaaactcctctaatttatttatttcttaatctatccttcctacttttactacacaaccatcttatcattctcatttctgtcacattcaatttgctttcatgtattttctttgctcctttatgtcccgaagatgcacctatcacataatattccagctacgtacctctatttcattcaatcatttctagttctattattatataatagatctaaataatgaaatcggtccatctatggtatctccttttcatcaatctttattgatattttatgcaaatgacgtatcatgttcaaataacgtacacaatggtacatctttctggaaattagatgcaagttgattcgtaatcaatacataaagatatggacttagtgctgatccttgatgcaaaaatctgttgtgactataaatacttgttgtgctatagcaacttctaacacttgctattatcctaatatacatgtccccaattatttcaacatacctttgtacaccattccattttaaatcccactaaattacttttcttggcaccattattgtaagctttctctaaaccaatgaagactatatggattttccttttctcttatatgttttctactaactgtctaagtgaaaagatagccttcattggggatctttcaggcataaatccaagttggttaactgaaatagttattatttgccttattatttgttcaattcctttctcataattttatagagagactcataagcttaattcatggtaatcagaatagttttgtacatctatattcttgtagacaggtactacaatatttctcctttaatcatctagcattttcttagttttcataatttcactaaatagactagaaagccaatttaacccaatatatcctataatcttccaaacctcaaatagatatttcatctgccactaatgcctcaccttttttgcattcttttcaaagctatgtctgttttgcttttatgaattgtatgaatagagtctttgacttctgggtgattgcactttttcaataaagatttctttagtagaaccctcatttaatttttttttttcaaaattttgcttctatctttctttaattttctcatttttcatcaatattctattatgctcacttttattccatttaacttgatcaaaatctttagttttcattctcacattcttttgaatcctacctatcatataaattatcatttgctttatatttagccttgctatatttttgtatctttactagctttcttatgttttatgaaatatttgaccctttttttttgccattgtttttgttttgttataattgtctcttgtatctcaatattccaccatctagtttctttatatatacttcttctcctttgtctcttgtaaaatatcttagctaccctcttaatatagttggtcatttggtctcattttgttcatttcaatccttaaattccaatttttttcttctaataatttctaaaagttataacattttcccttctaaatcctaccatcttatctttggatgtttattagtttcttttcctttcttctcacatttagtatacacaatacacatctaaaatagtaattgatagtgtggctaaactctctcacttgtatcactttacaattctcacatattgatctttctcttctcttaatgaaaatgtaatctatttatgacaaatttgatctgctcttaaggattattaaatgctcatctgtcttttcaaaatatgtatttgtaattgttaaatcataagtgtgaggacccgtgtgggcatgtgtttagaataattctctctcaccccaaataacccttattggtttgtccctacaacttggttatgctgtgatactatgtttatgggcaacaatcaagccgacccttgtccacttctcaccacaaccaagtcaggttgtcgtgtgtcgcatataacagggaatgccctagtatttattaggcgtgtcaaatttggagccatttcatattttttaacatacaattggctgtcaacctaatatcaaccgtccacttctctcatccagcttggaactggcatgggaggtgttaattgtttattctattatattaattatattatggcaaaattttttgggctcggtgttttttgtaattttgttagttggtcgcacatgataaattccttgtggatgattactacgtaagtagcagatcttaagctgatctccttgattttttaattttatattcaatctcatttagcattttgcaatgaattttcctatattgtggtttttgttgaagcactcagtggaacagtgattgtttatttcaaaagtgttacttttccttgtatattgccctctgctactattcgtcccttgtttagtttttacacatctgccctctcttaagttctaagaaacaaggatccttgtatgtgtttaaggtttcctaggctatgtgaccttatttttttggatctcttgtaactgcttgaattaaatgagttccaccagatagaggtttaattttttgtgctgctttcctattgaaagcaatatacatcttaatagtttgtccataattcaaactgtagcagtcctgcagttagatgtacctcaaaaaaaatttattcagctgacagctggacaaatagcttggtatgggctcaggtaggttcttaaccttctccttttggaagcagtaatttttttttcttttactacaatgcattcacagttatgtaaaccacttataaaatagggttgaggaagtgatggattttgatatattgcatgctgagtctgaattgaagatctaatttgattgttgtattgtgcagtggcttgtggggaggcagttgtcacctattgagatcttcatcattggttatgggtagagtatctttttggtctcttgtttatgcatctagtaactactgccactctgttagatctgtttcttttttttcagtaaaatttgctctcacgatcacattcttgatggtacttctgatattccttcaatgctttaggatttaatgtaatccttcatgacacttatttgaaatacttatgcatttgtttgatttcttagttgcatgcatatacttttgctagtacgaagggatcaaggaaaagtggtttgcatgatttgaaactgagatatgctcaccttttctgtatgaaatgcatattatcatgatccatttaggcacctacatagacatggtatatatgtagatgtgaatatgcatgtgtacttggttttttagcacatgaataacagccatattttcatacaaattagcaagacatttatatgcccaagcatatgcattagttattcattagtagtgttccacatacacacgcatttactagtctggtttgggttgcaagtggttcaattagaccctggcctgaccagaaatcaatgctgtctgaatgcataagtgtacagctgaattggaatattatgcgtttagaaaactctatgtagtaccactctttatctgataattggttgatatcctagcattgtcgttgtcatgatggtagcactgttccgaaataactgaaagtatttgctttctaatctttattaaaattgaaaattattcatttcttttgtcacaatgattttttttttttaaacaaaaaatgttcatgaacaaccagacacgttaatgcttttaaattctactgaccctagtactagtggtatttacttctttcttaagctgtatgagcatgtaaaatgaaggaacagaggaggccttaacaaatggaggggcttagatttgtttataagcatagaaaagatgagggcaaggcctaagctaagtttgtttgaagttcgcggaaggagttggagattttctcccgagtaccatcaacaccaaccgggtcgatagattactgtaatggtaccgtagcagactaccagtacttgggatgtgtaggcatctctatgcatactaggacctgtatttttaatttttctattcttttgttttgttcttcgttatgatttcttttatagttattgaggatcttttatgtttgtttaggttataaactaggtttacgttaagttttgttcttccacttgttcttttccccgccccccctccctttgctgttgttttttgtccttcgtttttcctctatttcttccatcccctatagggacggatgtctttctggtatggactggttgatgctgcttcccatcccacttggtacgagtcaataccagccgataacaaggatgtggtctggttctatgtgtttcagggtggtgggtgctgtacttgttccaaaacccaggcagtcaccattctgaaccaagatgttcagtatgatggtactgatcgggtcctcgatccatgatcaagaccttgatttgtttggttttgtaggggaaataagagaccctccaccatagtatagaaagttatgtgataaggctaagcttggatcagatgaggcccaagatatcaatgagaatgggaaattcttggcacactgtctgcggtgtagaaaatctgacgaggagtgtaccacctcatctgattggactacatagccactactttctaatgcatatttaatatccatttaatttctgcagttttactttttgatttgaaattttggatgacggaaatatctttttttttcgaaaaaaattatgatattttatgccgatattatgactttctgcacaggatgtcatagttttttcataggatgtcataaagagagaaggacattttcgtcattgaaaaatttcaatgacaatgattctatttggatctaggatcaggtttgatcctagggacttaaggtcttggtttgtggtttttgatgaaaagagcatcttgaaaaagtcgggaggtgcggctgaagttgaaaagtcagcacaggacagcattgggcagaactcgtatacaggtgatttgccatcaatatcaacctcggatcgtgttcagtttgaggtggagacgggcaggcatggttacacatctgtggaggatcgacgaggagagcaatctgtccaggaggaggtgtagagatagccacaggcagcagaattgcaggatagcgcaagaggagtggcactgtacaagtcgaaatgcactgttcataagccggtgcgatatagcattgatgagatcatttcttatgccttcatcactatcaatggagatccagagacctttgaggaggccatgaagagtttggatcaggagtcatggatgcaggtcatgatggaggagatggagtctctcagaaaggatcggacgtggcagttggtggatctactggaagatgctcgatccattggctccaaacggattttcaccagaaaggaggtacctttagagtaaggtggagtgaggtacaaggctaggcttgtggccaaaggatatatacagagagaaggtattgattatttagagatttttttcttcagttgtcaggcatacatccatcaagatgcttttgagtatagttgctactcaggatctggagctggagcaaatggatgttaagacggcgtttctctatgaaaatttggaggagagcatttatatggagcagccacaggggtttagagagtctgggtcagagggagatatttgtttgttgaagaaatcgctgtacagattgaagcagtctttgaaacagtggtacaagcgatttgacatttatataaggagcattggtctttacagatatgattatgatccatatgtgtatgttagatctctgaaggatggatgtaggatgtatttactcatgtatgtagatgatatgctgatagcatacaagagtaagaaagttgtgcaggagttgaaggcagctttctctcaggagtttgagataaaagacttggggcctgcgaggaagatcctaggtatggagatcatcagagatagaatcaaggggctgctacatttatctcaaaaaggcttcaaaaaggtcttggagagatttgggacgaaggatgccaaactgacggagttgccacttgtcaggcactacagactctcgaaaatcatgtcgccacagactgaagtacaggctcaggagatggagagaattccatatgcctctggtgtggggagcattatgtactccatggtgtattgtaggtcggatttagcttatgcggtgagtcagatgagtagatttatggcacagtctagcaggaagcactgacgagcactgaaggatatcttcaggtacttgacgggtttagttggagttggcatctgctatggttaacgaggaggtgttgagggatactccgacatgtccaaagaggctcggaggtagatagaggggtttgtagatacagatttgggtggagatatggacattcggcattcgatgacagattttatgttcaatctatatcgaaggcctgtcttatggagatcttgcttacagcccattacggccttgtccaccatcgaagaggagtatattggcatcatagaggcagtgaaggaggtccgatggctgaagggtttggcactggagatgagcttcccataggatgcaatcaggatgtattgtgacagtcagagtattttgttgttagcacagaattctgtttatcatgtaaggacgaagcacatcgacatcagataccatcggattagagagttcgtagaggatggcgagatggagatggtgaggttcacaccaagaaaaatccagttgatgcacttatgaaggtactttcgcgagatagctttcgatattatgtgggactgatgggtttactggacaggactgagttcacaaggacttgggagcaccaagatgaaaattgcgagctcaagtgtggtgctttcaagtcttaggaataggtgaaaagaggccaagggagcaagccagcagaagtttcagcaggtagcagtgtttctgcaggttcgtcaactcagattgagactgagtcgactaaattgcaggtgagttaatccattctcagtttggattaactatgtctcagaggatgcaccagatagaaagctgcatttcgggagtttcaggccggcacgctagtgagtcaactcagtgtcattttgagccaactcagtcgtaggtgagctgactcagttatcggacagaggctgcacgggattctgtttgggtctaggatccggtttgatcctacggacttaaagtcttggtttgtaaggtcttaaggggctaatctatggattggatgggatttaggtcttaaggggctaatctatagattggattggaatttaattttttaaatgatgaaaatgtcctttcttctttatgacatcctgtgaaaaacttatgacatcctgtacaaaaagtcataatttcaatccagaatgtcataatatctgtacaggatgtcataatttttttcgaaaaaaaagatatttttgtcatccaaaattttaaatgaaaaaatagaattatgagtatcaaatgtgcgttgaaaaatgatagctatgtggcctaataagacgaagcggtgcgcttcatattggattttctataatgagggcggtgtacaaagaatttctccaatgagaatatctagagtgggcctattaggatgaggatagggtgagggtgaagatgttcatacaagatccacatgggggctcttagaaaaggcaaactacctgatgcaaacttgggccccaagtattgaaacaacgcattgtcaacattctggagatcatttgtggattggctactcagccctgcctgaagatattttgttttccgactttattgaatgtattcagactagactaatatgattcctcggtcttatcagagagagagagagagagagagagagagagagagagatgagtctatgatatgttgtgctgtcttatatttattttctatgattaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctatgatatgttgtgctgcttatattatttttctatgattaatgcttccctgctatgaatgcggttctcgtcgtgcaactacatgcaacctgtgcatcctatgctcccatcaaacaatataatccagtctaggtcttggcattaagattttgtcacttgttaatagatatattgtaaataatttattttcacatacatgaacaaacaatgattatgtcttagttcaagttgttcttgttctccacttattttttcttcaatgccaaataggctttgaaagtgcattttcataataagctaagataaaattacttctgcgaccaattctgggtctcatgcaataacatatgggaaaataaaaacatgtaagttccactagctttgttctttaaaacaaatatatacatggtgtggatgccacaatcagggttcaaacattggacctcttctaagttgagagggataccaagcagccttagctggttggtattatccgccctagattttagatcaacagtaatgctattatttttaattcttgattattccagtggcaatgttgcggtccgtgggaattttctatctagagagtttacgaacggacggaagcgggcccaatcggctccctctaaaaggtcttagtagtgggaaactttcgctgaccataggctgtcgcggataacggttctcgccgtctaaacacggttttagtttacgagtgatgcagcagggagaaatgctccatgccatacaagtggtcaaattcactgggttggtgtccaccatccgagaacagaaaaggaagaaaaaaaaagaaaaaaggactcagacaccacgcaaacctgcccggcaattgattttaaattgggttgtgccatttactcccttttgttctcttaacaggagcaagaagaagattgcacttcagatggactgcgtctgcgtgtgattgaaggtaaaatccggaacccagacagtctttgtatcttccaactttaacccaacccagtcgagccttcggttgtcagttttactcaaacccaatccagttctatcctatgttaagcgaaattcagatgccattaattatgaagttgaatcacattaatcagataatctgattgaacaggaatcgttaacatagcaaaaaggttagtaatgtttttatgggagtaatatttattgttcaacatgtgaataattaataaatttggatagtattttgctataattgcataatttaacagaaatagatatataattgtataaacataaaatatttataaatatgaattagttatttattttaatattgtgatatgctgcttttgtgtacatgagtagctcgttctaccatgccgcagcagggaagttatgtaactgaaaggaattgatgagatacgtgaaggggtacctgtgtgatgaggttcaagccccgaattttatgggcttgattaactttttatgtgtactaatcagcatcctagatcattttgtctataggatattttcatgctatatttggtgggaatgctacccacaattgcaggaggtgaaaatgctattgctttgggccgatgattgaaggccccaacctacaacaaagctctcagggatggccggcactacaaataggcttagccaagctcagttgagctccttaattcgcaagatatgtaaactacaactgaaaaatttattggttgagcataaataataaattggggaagccagatctgacttcaggctaaagggcaacacagaataatttgaattggttgtcttatatctgcatttccataacttgaatggatgttgacctttttatgatagaagctactattactgctgagtcaagtaggttctttcatttctatctctaaaggccattcatattattatacagcaggctagatctgctactgaacatctactgttgtttgatatttggaagctagtggtgaaccacatcttatttattactaataatgtctataggaaaataaatagtgcagctaattggaaactcttttgttgctgatcattatggtgttatatgaatgccatatgagagtgtttttgtttaatttagagatgttttgttttctgattttgttagacatattcatataaggtgcatatgagccatctggtttattaagcacatcctttctttttttgcataatcagtctagcctttttctttattattattattattattattattattttattattttattatttttttggggggggaagtccatccatgttgggttaggttttggaaaatgctacaagtgcattaatacaagtaaaatgtacaatacgtgtcaagcctatccgaggaaataaatattgtgattatgcgcaagcatatctggatttttgttgagaccttttcttctttgtgataaaaaagaaagcttccatccattttgcaaatacaaaagcattcaatctctaaatccttgtatgggaattcaagttctaaccaatgcaactaacaatagcaactactgcaatgtcatatacgttggtttataattcaccaacaatatatttttcctcgccttctctctctctcttcttctctttacgtgctctctagagatcatcatttcttcatctctccgttgcactattaattcttccttagatccttcatcttcaaaattcaaattgatacctgaaaagggatggcatggatactgatggtggttgtgttgagtttgaggaatggggtgctggatgcttctcatatggtgtgccctcatctccggaccctgcaagtttccattatggacttttcgttgaggtctggctatcacttcttctggcctcccaaaaactagatgaatggtgacacttccctcccttttccaacatgttgcctcttcttctccttcggttttcctctctctctctctcttctctctctctccaccacttatctaccttggattaaaactattaagtctctctctcttgtagagtataattcctgtcggcccttgtgagcggtgatggccaccatctggtcaaactcgtacggcctataagaatttcatgggattggttcctttgcttgtttgacatagaagcatccaatactaattaccggatcaaatggttgttgttaaactaagggggtgtttagttggaggaagtagaggtctgaaattggaatcgaaatcggaatgggtgactctaaatggttgggaggagttttatttcgatttcaatttcaagatagaatgggaatgactcaatctatatagaagtcaatctctaatcttttctatgaattcaaatttttatttcaatttcgattccgatttcggttacgaaccaaacgattcgaagaatttggccattcgatttcgatttcaagccattccgattctcattttcattccgattttggttacgaaccaaacactctctaggaagtatttggttggagggagtgggggtctggaatcagaatggatgtttttcattctaaccgtttggttaggaggagttttatttcgatttcgattccaatttcaagatggaataggagtggctcaatctatatagaattcaatctttattcttctctatggatttaaatttttatttcgattttgatcacaaaccaaacactttggaggatttggtctttccgattttgatttcaagccattccgatttcggttatgaaccaaacaccccgtaaatttggtaatagttttaacaatacccaagatagttttttctttttaaaaaaaaaaaacaagcatcctcattcgagcagctacccacgaagcatctaaaggctattattacgacaatggtcatgatatttctatctaataggccacagaaacatcaatagcgaaggtccacctgtcaaagacattcgacattaacgggactctgcgacaattctccctggcaacgagcccccggtttgggccatttcgaaatattcaacaaggagacatgcacatacctacacgtttgttgtaaaatatactgctatttgataaataagtaattgctaatataatattagtccatgttactaatggcctttgttatacacttaggtcttctttagtgccacgtgtctatgaaccaatcttctccagctttgttgatattgacatagcgaaaactaggagaatctttctaaggagttcggtatgttaatcactctcttcatctccttataattttctcatcatctgttccctataaaattgttaagtgaaattgtcacaagatattttctaatcaaaataaatataattattaaaataataatctaatataagtataaatgaaatcattaatcctatagtaacaattcatacatttttatagggttaataattttgctgtcaaaattataattattccattcaaacaatttggcatataaattgtatggttctgttggccatccatatgtatttttttaatgatttatttaagaatcctatttaatagttgtaacatatatggaagggatagattttgtattatatgatcaatgatcttgaattttcatgatctatcaaacagattattgatggataactaaagaattttgaccattgaaatatagcatgccaaatgcgatgatcttatatcatcggggatcacattaccctaaaatgaggattactagcggtttgagatcacttgtagcgatctcatttggatcataaaataccacctaagtataagtagatgtgttgcatttaggctaagcagataagcatcatatgcaatagatctttttgtttttttcttaaaaaacaggacaaggagaggctaattgaggggctcgatatgcttccattattgtactaataggtctctttatcattagcataaatgatagggtaggactgacttcattttgtaaaaaaggaaaaagaataaaaatgtctagatcaaaacaaattgcaggcatattttagtaacactgcacgtgcaaatgcacatggtccaataatatataggagaatttctagggagaaatttgactttgacattatatatatatatataatatgtatcccattgaagtttcgattttgttagtatgaagttgtaatttatgggttcctttcctttccagaaatacgcgtaaatagaatcttgcccttgcgtatacctatgctatattcaagccttcttcttgatcttaagtaaaccaataccagttcttttaagagcttcacgacaatttacacggacataaggtgagacctctacctttcgagtgaggaggcatgcttccttcaagttgcaagcacaaaaacaatttttaccaaaaacaaaaaaaagtacaaaagcaatcaataactgcatatcttctgatactaatttaattatttttcaaaactctatttttgatctatatttaatgtataaaattagattacatctgatgactgaccatctatctagattactgataatttaaaaagatcttgttgattaccgcatttgatatgctttttggattgataatttagattatcttttatgaggtaatctggattatcaagaagagaagtggctatccagattacttttcaaaaggtaatcatgtaataaaattttttaacgaaatggcattcctttccttccttctctgcacggtgccactcatgcctccccctaaccccctcaacttctcctctgacggccctgcagcctcctacgctgtcttcgtgaccctcactgaaggtagtgcgacgaatggttagagggtagggagcagtggctagggcagcatggacggctgaggggccggagaggggtggcagtgcgacgggcggccaagatgcagtggccaggacagtgtaggtggctgggaggccgaggggccaaagaggggtagcagcgcgacgggcggtcggggggtcgggatgcggtggctagggcagcgcgggcggttggggggccgaggaggggtggcagtgcgacgggcggtccgggggccggggtgcgatggctagggcagcgcgggtggttggagggctggggtgcagtgtcggagggggcagggggggagtggggtcggggcgtggcgtgcgggggaaggaaaaaaaaattaaaaataataatttttataataataataataagtattaataataataatttttttcatataatatttttattattaaaaaattaaataaaaatttaaaaatattaaattaataatttgatttaaaaatattttaaaaatttgatgttagattatcagtaactacttgattatcatatcaaatatatcggtcaaagttttcagtaatttttctacaatattatttttgtgtactgaatacagtaataaatattactgataatctatctaaattatagataattcagattatcagataatctaaattatgcagtgtaatgtgctaaatgcaaaatatgatttagatcggagaggtagcggtccaaagcaagtcgtccctcccaggactccttccatgaatagtgcgccatctctattttcctcaagctctcctattccaaatccattctgcaggttcattgtgttcacatttccaatgtctggcattgcactgttttctccatctccattaattatactattcagccaagcttcatcatttcctaaggttgtcggtagttctggtatgccaagctctttttgctggtgctggcttccaaatgattgctgatcccttgaccaaatccactgcaatggtactctccatggtcgtggcttaattactcgggcatcagcacggggctgcgccttcttattttcaacttctaccttcttgcccaggtgagtgttccagtagttcttgatgtcatttgctgtcctgcctggaagcctccccacaattaacgaccacctgatttaccgaatttagatctcattagttgaagtgtttgtgttcaagtgtgatgattaaattgaaagggtcctttccaggacacgagattcaagaaaagtatggtactacacgaacatatctacgtagcaaatagtgctagaaaatagtggttgcatacccccatcgcatttggaggaagtggaatgatttaagaatgaaatctagcgaatcaaagatacaattgtacgtacgaaaaaaatagactgaaaatgtgttgatattatcacttattttctgttggcccaaaagacttcctgtgtacatagattccatttttaaaaggtgacgtaaatgctgctacaaaaggaatatagtaaaattattcaacaacagaaaggtcttgcgctcaagtctaaatctgaattcatgctttgtcagcctacttgtttggaacttaaggatttctaactgtggtctatgaagcaaacaagactcatggaacgtgagcttacattctttgatagttacgctcagcatatgatgaaatatgctctattttgtacttcatcaaggttcctttcatatcttgaaaattcctgcaaatacccatccactatttgtcatcgggaccatcttttcttttttttttgataaatataaattaatgtagatatgaatagcagcgcaaatttagtttccgtccatatcaaagtagatttggttgtggaaatagattcagacaaataatatcctatccatctttacccttacagtgcacctttacaaacatgcaaaatttggacctttatgagttacatatatcatatatttctagaaaaaggaacaatattatcatgacaataaagttatactggcaaattcttatatattatattcattataaatttctgatggatctactataatttcattaaataatactctctctgtctttggaaaataatgggacttagaatgatgcagattgaaacctcactggctgttactatgctcttataatttcactatgcttggataatatttgttacttttataccataagatagtaatccatctctctctctctcccccccttctggtgggtggagggattcatatagtattcactccatttttcccttctcttgtggttgatggtcccttccattcatgaagaagaacactagaattttgttatcaatggaacaaaatttttctcaatccaacatggtactgcattaacatgccctttgaatcaaaccaatgctcttttgccacattagctccatgaactttatattgcccagtgatatgaagcatttcgtattcattaatgatatattttattaacatttttttcattcttattattcatctgattgtagttaactttataaattgtcttgtcacatcaatattttccaataattttataagtgttttttttttcagttgaagtaatatgatggtaatgtaccggtacaaggatttgaactttatatacccacggaaataataattctaaggagaggggtgccaactataagagctaacagctgtacaaaactatatatatatatatatatatatatatatatatatatatatatatatattcaggtaaggaatagcaaggtcaaagaagcgaaacttttggaacctctcaagagaaaacaaatacatggtcactgtaaccaaggcaatcttcatggtctgttgttacctgttgcccaagagcttatgaagcttaacgataagatctgtttcttcctcggcaaatgtcgccctgttgatcctacggcggagatagttcaaccaacgcagtcggcagcgctttcggcaccttctgaggccttcaaatccacaaaagcacaatgagttcaagaatgtcgacaaaggactccgctacttataaggaatcgcttacctgccatttgtggaacatggcgccacttcccttctccatatttctcaatgcacttcctcagaagcctgtcctcttcttcactccatgctcctttgcgaacacccggacgttggacttcggcacgcaaattacccattgagaccaaaaccttagcttactgcaatttcaagttgcaggatactcggtgaacgtgtacatggtcttgatgatgcttgataagcatccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgctcccaacagcgctcccacggagaggaggagggacgaccacggtgcgacgaccgacggtcccagcggccctctccttcccggttggaacggacaaggaaggagaagcggccgcgcacaccgtcctctctttcagaatcttccggaggctccacctctggggtctcccagcatcgacgaggcgattggccgcaacacatctatatttgtatgattgcaaacatacttgggcttgtttccacttggtgctacgtacaagcacttgtgtggtagcttctccttgacatgaatttagcacctaccggtgggccattagccggcccaaaggacaaacatatctgtgggtggggctgctgatggggatgtccaagcttgatgacttataagttcttgttttttgatgtcaagggagggtctgaatgcccacccaggttttatttatagatagattatttacaagaccaagatgaaagaaaggtggttgttctacatctaaaggcgggtctggccttggtaaggattggattcattctcttttcgagatgaggagatgaggtggccatgtaacaaaacttatccctcaaacatggaattagccaaaagacaagaacgtgaaccaaacaaaaaagcctgggtattcggttgttcgccatcgccatagtcgcatatacccagccgtgaaattgcttaccaaggtcttcgataagcttctttaatgctgataccattattctttgtatgctcatgagttaaacttccttttaaggcgacgaaggaccaaatcccaggccagaacaacgtgaaaaaattgtttgatctcctgtagcatggaggccagtggattaatcaacttgaatgctgtggtgtgtatgcagtagtaggagcatagcatcatgaacatcatcaaggcatgtttcttttattccagtttggcgacccaagtacgagttgatacaccgttttgcaccatgatgctactgtggcgtgctttcaagatgcatgactatgatcagctatggggttttgatgtttggactactggctgtaggaccgcaatctggttttgatgtttgaagtttagcagcctctgttgcttttcttgcaacggcagtgcagcgtttgtaacttcttttatttacgttccattcagtctggaagactccaaaatgtggtgcaccgttcacgaatatcttgccattggaacgagcagtcccgctgacacggaccatgtgccctattcacgtgcatgatttgacctctcctgcagcatttctctttaaattcggcaagtgtttcgttggagaaatttttgatgcactcacttgaacctaccgtgcaatggaaatataaatcttttaggtagggtacgatgccaggagagtaatcaactgaagtatcctggaatgtttccaaaaaaaaaattgaagtatcttggaagtaaatttgtgaagggagagtctccacgtgcgcagctaaaccacgtacacacgttacaaccgcctccatgctgccacgtacatatacatttagtttattctttgcttcccaaatataaaatttatagataagaaatcactgaagggtccaggcaatgtacgtggtacctcgcagtgttgtgccagggtaaaagatgctgctcatatcgatccggagttaagtccgggaaggttgacgcgagaccgttgcaattactttaatccttcccactgtggcggcacgccccacggtggtcatacggcgcacaaaaatccaatttggcatccatttcaggcgtacttttccatgtggctgaatgaatgggatgggccatgtgttctattcaatcgcatcaactaaagaagccaaggtacctaaatatgtaacatatgcatggctgacaaattaaccatcacaaagggatttgtctacttccttgccgttacatgatgtgccctttctaaaatatagatggagtttcatgcaaggactccctaaagttctaagcatcaactattgggttcttattgtagattccacggacaatttgcacgcaaacatctacgataagaatagataagatggaatcttaattaaaaggcatgccaaagtagaaacaaacaacagatccttgtgatatctgatcccatatgcatctgcaagaggattcgaagtagatgtgagtggattactgtcacgccccaaacccagcacctgagttgggcacatgatacggccacacaaaccctagagcagcaccctaggatcatgtaaggcctaaaatttaacacttcaaattttaaataaccaattaaataccaaaacaatcaatcgatgtcacagcttcaaatcgaaagcaaacttgttcaatacaattattcaaatgttccttggcatcagagaatttaaactaactaaattactaaggcttcagttcttatttgctctcgcccaaaccgtccaaactacgcatcctgtaagtctgaaaaaaataagaaagaaatatgagcttctccagctcagtaagaatcactgcacatgtacatcaaactagtagataaaattaatatttctaaaaccaatacaattgagaaaatatgcatatatatcatcaaaccagtaggtatataataactggaatattgtcacaaatatgcatatatatcatcatacatcatcagatgaaatcttcattcattgtttgaatttcatattatatgtttcattcttcacatctttggaatgacaaccttttattcctttttggctttggactaaccaggatcatgcgacgatcttttattcggatcgatttctgtgatcttcctcggatcgaactatttatgatctttctcggatcaaagtggccatgatctttctcggatcaaatcattcatgatctttctcggatcatattcttccacacataagcctgcggcggctgtcccaggcataagctcctggcaggctattccacatgacaaggtcagtccaaaccatatttctctttcttttcattttcatgaaattataatatttgtcttcattaatcaattcaaattttgcagtatactcaaaataaacatatcataactatataatcatgccatcatatgctttgatgaaaatatatttatgctcgcaaccacacaagtaaatgtcaacattacatatgataaattcattgatttcaaatccaacgatgcaaaactatcagtaaaataatatatacatgtgatgatgatcatgtataatgattcttacctcgataattgagaattcaaattcacaactttatagtccaaaaatcaagccctactcgttgtctccctgatcgttagactgttctcctatcaaataaaaataaattaatttaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagccaccttctccggcaacgtcccgacgccggtgatgctactgtgtcggcggtagtgccaccttctttgttgccgacgacggagaaagaagaaaagtcacacaaatagggtatccctgtttgagcctgaaccggcacctcgctggcttcctaacaccccatggccggagagactaaactgaaaggaaggaagaaggaacataccttgttccggcggccaaaaacagctccgacgatcccttttcttccgatcaaccactacggtatctttgagaaaaatctctcaaatcccttgatttacttcaaaatttttgttgtaaattcctaaagaaaggatgggggatctgaagtgaaaatttagtgcaggggcaaaatggtaattttaaaatttttcaaaattactattttacagcggaataattaattaatcttattaattaatactaattaaccctacactaggatctaaatatgatacaacagcatgcatttaaatttgaaattcaaattttgaatcagtaaacgttttacagtattgtgttcagaacacatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaaacaaatctactatctcgatctgacacaataataactggtactccatgcagtcgtacaatctgctctatatacaaacctgccaatctttctaaggaaagaccaatccgaaaggataaaatgctgttatctttcaataagtatttttttattagtggcactttatcataaatgccgctataaatttatattttatgagattttattataaatgctactctaaatttatattttatgatattttattataaatactgctataaatttatattttatgatatttagcaaatatgctcataaataatatcataatttataggatttaaaaaaaatatcactaaattttaaattattaattttatatagagcttgatttaataatactgatctcataaaatatattattatacatatatattcttaacattacttatttaatgacgtgaatgtatgttaataagttaaataaactatatttatatagtaataatataagttataggttggtggttaagagttgttattgaaataaaatatcattgattcgaatcctactcttgttctaattttaggatatatagttcatcttttgataatttttatcggcatataaaaaatactggcattaaaattttaaaggtacttatatatgtcgctaaaataaaaatttttatcgatatttttttcaaaaatattgataattaattatcgataccatcttaagacagcacataagaaaatgccgctaaagatatttatgatatttttttttctgatttatagcgggacttaaaaatatctctaatggtcatttttattgcaatggtggagcaacgcatccgagagaaggggaagagcatgtcgtggtggaacccgatctatagtgttttgaccaaagcgatcaaagagaaagaggaaggaaactaggaaaggaaataaactttgggcttatagtgggagagaagatgtggttccctgacctcaaagcttgcatggggaaaagttgtaggttttggaaagaagaggaggagagggactggatgatcaaagaagggatcacgatgtgcgaggtctacacctacttcgtatttgatctcatcataaaggagagttgtaaattttctctctcctcttcttggcctctttggcagcagcaagctagtggatcttggcctcctccagtgggagagattgcggttgaaggggccagtgaggagggccttgctgatagattttacggcaaactcctcatcggagcccaaagagtagtggtacaccattatgtatctacccctttcgatctacattgatggattccacttggagacatagatcattgccgcttgtaattgggtgaagggtggagcgatgctcgaggggtagaggatgtaggttaggatttcaaaaaagagcggaaaggagtgggggtagcacttttattttttcttctttgagctgaggtggcagaatggccacatggtgaaaatggacaagtctgctatatcattgaagtggtacatcaagtcatgggcccatatgttacttgggcttgatttgagtccaagctcaacttaattcgactattattgagttcgaatagtaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatattagtaggctaagatttaaatttaagcttgattaagcttgaatatggctaggttgatattgttagagttgagttgaattgatattgattattatcttttttttcgtcgagctgaacttagcttgggatattaagactcaattgattgtgagtcaagtttcgagcctcagtattctgaatgaagtcgagtcgagcttttagctagtcgactcagcttagttcgattgtatcccagattgctcttttgatggattgcgtgttgttgaaggaaaatccggcacccacaaagtttttgtatcttgcaactttaacccgactcaatcaagccctgggccggcaatttttcttaaacccaatccaattaaatcctatgttcagctaaattcagatgtcattaattatcaggttgaatcacattaatcagattacatctgattgagtagaatatgttaacacggcaaaaaggttgtaatgtttttatgggattatatttattgctcaatattcgaatcattaatcaacattgataatacatttatgtaatttcataatttaacagaaacagatattaaattgtataaacgtaaaagcatttataaatatgaatcagttatttgttttaatattatgagatgcttcttttgtgtacatgaatagctccccctaccatgcagcaacaatgaagttatgttacgcagagggatagatgagatacgtgaaggggtaaatgtgatcaagttcgagccccgaattttatgggcttagttaaccttttacgtgtactaatcagcatcctagaacattttctctctaggatttttttttcatgactatatttggtagggactgctgcccacaattgcaggaggggacaatgctattggattaggcccattgattgaatgccccaacccacaacaaatgtgtcagggaaggcctgcactgaaaataggcttagcccaagctcagctgagcaccttaagtccgaagatacataaaactgaaaatttattggttgggcataaatgataacttggggaagcgagatataatttcaggctaaagggcaacccatgtagaataatttgaatcggttgtcttatatttgtattttcgcagcttgattgggccgctttccaatttgtggtagaagctattattactacagactcaagtaggtcctttcttctctatccctaaaggctactcatattttatttgaaggtgcttggtggtgggatagatttacgcagcaggccgaacttgctatggaacgtcttagaacctagtggagaattgtatctcatttgttgcaaataatggctatagaaaaacatgcaatgcaactgactgggtggtttcttttattactgatatatgcatgtagtaagatagtgtacatgtacaatttagagatattttatattctaattttattagatatattcatacaaaacgggtacaagccatccgatttatataagggcaaaaaaaaaaaaagcgctttcttttttccataattacacttaaagagaatcccgcccatgagtagacctatgctatgctcaggccttctagtttatctttcgtggaaaaatccatccatgttgggttgggttttggaaaaccctgccggtgcattagtaaaatggtaccagacatgccaatcctatccgaggaaacaaattatcatgattataccagagcatatctggacttttgttaagaccttcttctttgtggtaagaaagcaagcctccatccaattggcaagtacaaaaactcccaataactacgtgcaataggtatcgagtcttaacagatatataattgaattatgtgactaggtatgagattgtagtattttaggctagccatcttggtgctctatcaagagcttcaaaatgtgactacggtagttcagagtcaaatatttgtaattctctaagctagaaacttattttatataattcattatataaaaagatatgtatttgctatgcatattttatgattataggatcttgtgatatgagatttatatgataacggttatatattaaaaatttttaatttattattattatattaatattgatttatgaaaatttttattggattataaagctcaaaactcgcttctttttttttctttttcagagttacaggatacttatatttggctatagttggaatcacgtacggtcaaaaaaattgaacatatatatagaacatcatcaaaatcaattggatgatttagttttatgaattgaatagatttttattatttgataatataaaatattctattattatgaattgaaatcattggtattcatgtaagtttgagattttaataaattttaaagccatatataccctttagaactttagaatgcgtagtcgattgcatttggaacgtgacaaagcctatatgaggaaatgaatatttatcaacatatagagtgcttttaaaagcttcacgaccatttacatagacttacgtaggacctccttttcttccggcgagaaggcatgcttcccacaaattgcacgtacaaaagcaatcaacaaccgtataccttctaataccaagcgtttttttcaaggtttagtttcctgtctgcatctaacatatgaaactctacatccttgcatgggaattcagctagcaagtcgtcccatcctatggatatgattcaggttgaagatatggtagtggcccaaagcaagtcgtcccatcatagaactccttccaaaagtattgcgctatctctgctttcctcaagctctcctattccaaatccactctgcaagttcattgtgttcacatttccaatgtctggtattgcattgttctctccatctccatcgattgtaccattcagccaagcttcatcattctctaagattgtcggtagctctggtatgccaaactcttcttgctggtgctggcttccacaagattgccgatctcctaaccaaatccactgcagtggtactctccatggccgtggcttaattactttagcatcagcactgggctccgccttcttgtttttagcttctactttcttgcatcggtgagaatttcagtagtttttgatgtcatttgctgttctgcctggaagcctacgtgcaattaatgaccatctgattgaccgaattcagaactcattagttgaattatttgtgttcaattgtggcgatttaattaatagagtcccttgcaggacaagagattcaagaaaaatacggtacatttacatctctacatagcaaatagtgctagagcacggtggtttcatacccccattgcatttggaagaagtggaacgttgtcaagaatgaatccaacaaatcaaagatacaattgtacgaaaaaatagatggaagatgcgttgatattatcccttattttctttaggcccgaaaggcacttcctgggtacaggtttaagtgcgcatatatagattccatttttaaaagctgatgtatgtgttaccacaaaagaaatacagtaaaatcattcaacaaaaaggccttgtgcttaaatctaaatttggattcatactatttatcaaccttcttgcttggaacatgatagtatactggaaattaaaaaggccttgtgcttaaatctaaattccgattcatactatttatcgacctacttgtttggaacatgatgatatactggataaaacaaagcacaagaagatttctaattttgatctatgaagtagacaagacaaacagaagatgagcttaagttctttgcaattgaaggttacactcagtacatgatgaaatttgctctattttgcacttcatcaaggttccctttcataccttgaaaactccagcaaatacctattcgctacttgtcatcaagacaaggaacttttgattactttgtaaaagctatataagattaaatataattgcaaataactttggatatttggatacaggtcagatattttattgattttttaaatttttgataaatgatcgattttgatgtcatatccatgtcttctgttgcagttttaataatgtggaggacaccaatagtcccatatcggttgtgagttaaggaagactcgcgcttataaagtgaaaaaaaattcttcccatacgaggcatcttttaaatggcaaaaccgtgaggcccatgggccagagcggacaataccttacgtgatgagccgagcctttgtccgtaacaatgacgcgtcaggtaggaaaaaaactacaatcaaccatgtcgaaaatcagagcttaacactcgactggatcgacgaggcaatctttcagagcttaacactcgactggatcgacgaggcaatcttttcaccgagaagatgttccttccccacctccagtggcaaaatccagttcttcgcgtcctgtgtttactacggatgtgcaaattgctgcgctcatgcagcaaatgaagattttgacggtggcggttcaaagcctctagcagcagcaaacctaaccgcagcagccatcggtggaggagtcggtggctcattccgtgccatctaagcacaaccgccgtcctccacgacgctcaccttcctcttcttcagagcggagttttccaacaacggcggctcgacgactatgaacgcaagttcaaggagattgattgtcagcttatccgacttcagatggaaggtcggaagtcctccagcgattacgacttccacactgcccagcctctctctcagtgcatcctggatgaaccgattcttttttggttcaaaataccacagatagagtcatacgatggttccaccccgatcgactatctgaagagctataaggctctcatgatgatccagggggcaaccgacgtcctcttatacatcgactttccgacaactattcgaaaagctgctcgagcctggtattctgggctttagtcggaaagcattaactcttttgagcagctcgagcattcttttgtggcatacttcagcactagtcgaaggccgctaaaaacatcagacagtctcttctccatcaagtaaggtaagacagagatgttgagagaatttgtgacttatttcaatgcagccacacttgaggtcagggacctcaatgaagatatgactatattggtcataaagagggatctaaggggatcgagattcacctactctctagataaaactctccatcggacctatgttgaacttctagaatgcgcgtataagtatattcgtacggatgaagctgcttctgaccgacgtcagatagatgaaaaagatcagaagaagaaacaatagaaaagtgaagctccgatcaaatcaagtaggtcgactatcaataagcgagcttcacctcgacgacggagtccgaagctgaataactatggcaggtatgactcctatacttctctttctgctccctgcgcgcagatcctgatgaagattgaaagagaggagtacttacgacaccccccactaacgatagcactgtcgaggagccgagataggaagaaatactgttagttccatcgtgatcatagtcatgatactgaacaatgtatccaattcaagaatgaaatagaggccctgatttgatgaggctgtctcgaaaagtttcgacgagatcatccgactcaacctctcaccgaccaacaacctcagtcacaaactgaggagacactcaacaattgatcaatggcgggagtaatcaacatgatctccgaacgacagaagaactggaggacaactttcgaagaagagtcggcgaagaaacgactactcgacaatataattactttttcggaagatgatgttcggggaatacaaactttccatgatgatgctgttattgtctcggcaacgatagcaaattatgatgtaaaaaaaattttaatggataatgaaagctcgacgaatgttttgttttactcgactttctttcgaatgcgattaccgactaatcgatttaggagagttttgacgtcattagtcggcttcactggagatgcggttactgtgaaaggagaaatgactcttccattaactgcaggaactgaaccataatatttttattttttgataaatataaattaatgcaggtatgaataatagtacaattcgaatcttcatccatatcaaaatagatttcactgtggaaatgaatgcatatgaatataatattctgtccatcttcacccttatagtgcaccaatggagagacttcgccaacaagcaaaatttggaccgagttatatttatcatattttttaaaaaaataatactatcacgacaagaaaattatagaggtaaattcttatatatcatattcattataaatttctgatggatatgttataatttcgtcaaataatactctctctgtctttgaaaaatagtgggaccaaggacgaacatggattgagacttcgctggctattactatggtcttataatgtcattatgctcgcataatttttgttacttttatattataaagctgtaatcatatgtctctctctctctctctctttttcgggtgggtggaggtatcattattgatttcgcctcatctttccttttccttgtggtcgatgggtccttctattgattaagaggaaaactaaaattttgttcatagcggaatactttctcaatccaacatggtgttccgttaatatactccttcaatcaaaacaacccttttttgccgcatcaacatgatgaactttattattgatcaataacacactacagtgaaaatgataaaagacgacgctattaaagttattttacgacgctaataagcgtcgttaataaagtttacgacgtttcaaaaagcgtcgcaaaagcgttgcctatgtaagagtggagacgaaaagcaccgacgctttttaaaagcgtcgttattttttaacgacactttaaagcgtcataaaattcaattataacggcgctttttagcgtcgttaatgacaacgcgtcctctactctaccaagacgctttttgaagcgtcggctgttaagtctttagcgacgcttataagcatcgttaaactttttttaacgacgcttataagcgtcgttaattttcttgtaacgatgctttaaagcgtcgtaaaatttaattataacggtgctttttagcgtcgttaatgacaatgcgtcctccactctaccaagatgcttttcgaagcgtcggctttttggtctttaacgacgcttataagcgtccttaaaattattttaacgacgcttataagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacaatagcagagcggtggcggcagcggctgtgctaacggatgggaagggaccgggggcggagatgatggggaaagaaggatggcagagcagtgtgagtccatggttctaaaagctcctaagaagaagagaagaggaggaggaagagatctcacctgaccacgggagcgagggagacaagggcgaaaaggcggcttgggagcgcatgggaagattggggtggtagggctgctctgaaccagtgaaccaggcactgaatctggaagcccgttcgatcaccgggagggaggaggggaggagggccggtgcggcatggacggcgggtgcgctgccggcggcggagatggggtcggcagaggaatgggtggaaaggggcgacagtagatagattagggcatgggagattgggactattaaacgaacctaacgacgctttttagcgtcgttaaataatcacgtaaaaaaacgtcggtattttctttatttaacgacgcttttgctaaaagcgtcggggttgacagtgctcaaattttacgatatttttaagcgtcgttaataaacgacgctttataaaagcgtcggcaggtcagcgcaacctgccgacgctttccaaaagcgtcggtaaaaaaaggtcgataatataaagtttttttgtagtgacatgaagcattttgtattcactaatgatgtattttattaacaatttttcattcttattattcatctcactgtagttaactttttaaattgtttcataacttatcacatcaatattagccaataattttatgagcttttttttcaagttaaagtaatttgatgataatgtacagtacaaggatttgaactttataagcccatggaaataattccttgggagaggggtgtcaaccacgagagctaacagctgttcaaaaacgaagatatgtatcttaccaaaaaaagaaaaaaaacaaagatatgtatatataggcaaggaatagcaaggccagggaagtgaaacttttggaatctctcaagaggaaataaatacaaggtcattctaaccaaggcaagtaatcttcatagtttgttgttacctgttgcccaagagcttatgaagcctaataataaaatcggtttcttcctccctgttgatcctagggcagagatagttcaaccaacgcagtcggcagctctttcggcaccttctgaggtcttcaaatccacaaaagcacaatgagctcaagaatgacaaaagactccactttctataaggaatcgcttacctgccctttgaggaacatggtgccacttcccttcgccatatttctcgatgcacttcctcagaagcctgtcctcttcgtcactcgatccatgctcctttgcgaacacttgggcgttggacttgggcacgcaaattacccattgagatcaaaattgtagcttattcactgcaatttccagttgcaagatactcagtgaacgtgtacatggtcttgatgatgctttataagcatccaagggcagtcgcctgactgcagacatacttgggcttgtggttctacttggtgcaacgtacaagcacttgtggataaggtcatgagcagtagcttctccttggcatgaattgagcacctaccggtggaccataagccaggccaaaggaaatacatacctgcaggtggggcatggtgatggggatgtccaagcttgatgagctcgacttcttgatttttgacgtaaagggagggtatgaatcaagatgaaggaaaaggtggttgttctacatctctaggcgggtctgaccttagtaatgaagaattgtattcatcctctcctcgagttgacgagatcaggtgaccgcgtaaaaaaagttatgcctcatatatggaattagccaaaagacaaaaatatgataaaaaaaaaaggggggggggggggcggacctggcttccttaacgctgtctcccagttttctttttacgctaatgagctaaagttcttgttagggcgacggaccaagtcccggccagaagaacaacgcgaaaaaattgtttgatctcctgttgcatgaaggtggattgatctaattcaatgctggggtgtatgtggtagtaggagcgtagcatcatgaacatcatcggggcatttttcttttattgcagtttggtgacccaagggctaagtacgagttgatatataccattttttcttttggagagacaacgctcccccatcaaatttattagaagttgtgtaaaagtacaagactgattgttttgatagattgatgtttgacaattaggatgggagaggattagcactgtatgccattatataccggtccaaaagatgttcccaggggctttttacatcgaggtttgaaagggcgttggtcatagaggagtgtcgaaaggagagtttcctggcaagtgatcctttgagagagttgcatgagttgcatggcacgagagtcgcaagtttgcgtccatgggtgcatgtggtgggagagttgatatacaccatctggcaccacgactctaccgtggcgtgctttcaggctgcatcactctgatcacaggtcatgtgttggttttttttttttgatgtaatgggaggctggaaccagccacccagcatttattacgagaaaagagagttgtacaacaaaaaagagagattggtggaaggtcggaatcatatatatatatatatatataaacaagaactggcggaaagtgttctgttttataattccagaaacaatcagaaaacaaaaaaaaatacatagcatagatcaaagtcagataatcttcaattgaagcttgccgattttctttcaaatcttgccgaagtcaccaagctcggaagtattgcaaagaatcgaccatgtgatgttacgtcataatccaatatcacaaggtacaataaaaaaaataaataaatatgcagatcgatgtcaagcatactttcatagaatatgcaagctttactatgagagaataaaataaaatcaatacaagagaaactcaccactcaccccttgtacaagaatctttcaaaaaaaagtctcaaaatctttataaaaactctttgaaacttctgttgaagtctttctacatctacagaatgtcaccagctttccaacgtaactgacagctcgtcaatcagaattttatagactccaaaaactccaaaatactattacactaagaaacagagtctcaatcaagtctagaatcatctgtggcagtccgatcgtgaccggctccaaccagagccatccgatcgcacatatcagggccactgatcagctgatcaaattcgaaatcatcttcagtcgtccgatcgtaacaggatgcgatctgggccgtcggatcgtgcaaaaaatagcttaaaccatgcgtgaactgcgtgtttggtccacgccggtcccatggaccacccagcggcccgcggtccacgatggaccgtgcagggatgttgggtcgcccgtgcgtgctgggccggcccgcgcccctacacacgtgcttctccatcgggctcggcggtgccaccaccagcttgccactagccgctgccgcctcgtgcaccatgctgtccgctccaatcttcttttgtgcatatcttctccatttgtgcactcttggactcgttggactccattcgtcatcttggaccttgctgtgagttcaatgtggataaaatcttgagaagtattttctaataatcttcatctcgactcgatattcggcctccatctatctctgagagcctgtgatcagtctcatccccatgccctagggcatgcttactgtctcatggatggacaaatatgggagttgagccaggccgctcgatcccacctccgtgatgggctatgtccactctgaccaaagtctactcagagaagtctcatgcggcaatagaaatctcatcctgcgatatcacctctcatccttccgaatctcccatctcgtacccgatccacctccacctggagctccacctcgcattggattcttcttggctcctgaagctccaccttgcactcggctttccgccaggtagtaatattctctcattctcttcttctcctccaaaacaatcctatcgccgtgcaacaccgtcaggattcctccatcagctaccattttgtagcctctcgaatccagtctgcttagtgagataagattctatctgaaatcagatatgtatcggacatcccccaatctcctaactacatcatcatatgtcctccagctgaccgtcctgatgtctctaatcgcacagctcgatccatctgacagataaatagtaccctcactgctttctagggagtcaaactgctcttctctgtaacatacatgataggtgcatgcagaatctaaaatccacagctgggaagaagtaaatacctcatcagatatctctagggcatcacgctctgagtcactactgaccgtcgctacagtagccctcgtctgatctctgagttgaggataatctctagctagatgccccaactcatcacaccaataacatttggtcttgctcaggtctctcatcctgaacttggaccgccctcaccgcgatctcctatcgctctgtctgccgcctcctacttcttcaaaaactatcaaagctgagctgccgcctaagctcgaagctaggtttttccttctgagaacctcattttgaaaaatcgccacgatgacctcatctatcttgatgatgctcttccccactagaagagcagtcaccaaagagtcatatgaaagtagaagcgacgctagtaagaccagtgccctgatcttttcctcaacttttttgcccacactgaggaggtcggtgaggatcttttggaagtggctgagatgctcctgcacgctctgtccctcagtcatccgtagctggtagaactgcctctagaggaaaagagtattggtgagagactttactatgtataactcctcgagcttcgaccacagtatcattgaagaagtctagccaagtacattgatcaccacctcatttgctaggtacaagcaaatcgtacttactgtctgcatttggagccgcctccaatcctgcacctctatggtagtcggcttcttctcgcacaagagagcatcgatcaactcttgctggatgagcatatctttcacccttgtctgccaccaggagatattgctctttccatcaaacctgttgatcttcactttgattatgattgtcttctctatcttctatcttgtttaccactgctgcaacctacgctctggcaccatcttgctctgataccaattgttgcaccaggatccggtaccacaaggtgcagtaggaagaaaaaagaaacaaaacaagaaacataatacaaatatgtggatcggcctcaagcttatcttcatagggcattgaagcctttctgcacctccaggacatcaccagcttcccaatacaattgatggctcatcaatcagagttttatagactctaaaaattccaaaatactgttacattaggaaacagagtcccaatcaagcctagaatcatccgtggtcgttcgatcgcgcatatcagagccactgatcacctgatcaaattcgaaatcattctcaactgtctgatcgcgataggctgcgatctgaaccgtcggatcgtacaaaaaatagcttaaactgtgcatggaccgcatgttcggtccacgctggtcccatggactgcctagtgccccgcagtccatggtggaccgcgtagggatgctgggtcgctcggatgctgggccggcccatgcgcccgcgttgggcccgcctgcatgttgggctgcatgcacctgcacatgcgtgcatctccgtcgggcccgatggcgctactgttggcctccgtcggcccgctgccagccgccattgcctcgtgcatcgtgtagtccgcttcgattttcttttgcgcgtatcttctccgtttgaattctatttgagctgttcttgaactcgttgaacttcgttcgtcgttttgaacctcgctgtgggctcaatgtggaccgaatttttctaacatgtgagaaattcgacgagtgtttcttgtaagacgtccatgatttggcctcttgtgcagcatctctttaaaattcgacgagtgtttcttgtgaggaattttcgatgcactctcacttgagtgcctcgattaggtccaccatgcaatatggaaatacaaatcttttaggtcgggtacgattcgaggagagtaatctgctggagtcgtttgaaaagtaattttgtgaagggagtgtctccacgtccgcagctaaaccacgtatacaccttacaaccatctccctgctgctgcgtgcaacaactccgatcttccgtaaatatatatatttaattttttttttttacttgttgaattgaaaaattaggatgagatctaaatttatctacaatatcttcttccgtggcatgcccctatataatttttcctggccatcctatctagtagggtgattagagactgaagtttttcatgcatgtttgtttttcattggaagagaagacctggattggaaaaccccttttttacaatcttcatacggcgcacaaacattcaatttggcacccatttcggatgtgtacttcatgcgtttgaatgaatgggatgtgccatccgttaccattcaatcgcataaattaaagaagctaaagataggtaaatatgtaacatgtggctgagaaattagcagccatccttgcttgctgttgcatcatatgtcctttcttgtgtaaatttgtagcatacatgatacatatggccaaccgatttaatcatcataaaggggtttgtctacttgctttccgttacatcatatgtcctttctaaaatatggagctacgtgcaagaagtctctaaagttttaaccattagctcttgggttcttattgtagattttacagaaaatttgcaggggtgaactcctacaataagtactcatatatatcagttaccgtgtgattttttactcttgcattcaagacattttgagaaaacagtattttcaaggtgtgaccacgagctttgtaagatattttactttctaatttataaaatatactcacactaaattggtgtgagagtcttgttggggaatacccactgaccgatcgatcgatggccggagggaccgaccgaccgactgacggccggaccgaccgaccgactgaccgacggccggagggaccgaccgaccgactgacggccgaagcgaccgaccgacgggtgccatcaccggccgattaacggcccacagccgactgaggatgtgtcggtcgggcatactttttctgaccgactgaacctagaagtctgatggccgactcacgtaagactcgccgaccaatagaggggcccgacgccactcagctggccaccgacctagggtcggtcgactcctccgatcgccgtacagccgccagagcttgttagttctgacagcaacatgcggcacgaccccctaggggcattgtcccgccgagggcattgtcaaccctagtgatttgacagccccacggcgatatgacattttcacggtgactctgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgaccttgtttcgtccgcggggtccatcggggccttccctcgatcggccgccccgaccgacggaaccgacagcgaggggatgctcgaggttgaaccggcaccccccgttgcggccacagacgtcgccggatgatgttcgatttcccgaacgtcatccggttccaccgccgccggtgaggccgccgatgttccttcggccgcttcttccaccggcctcgcctccgaatgcgctgtcggagccacgagcgctatgaccggctccgattgatcggccgccgatgcttcgacggtcggcgccgctggagtaggcttcttcggaggatgcgaaggtcctgcccccgatgctggcctcttccttgctgcaaattgccgaatctcggcgtcggtcggccgcattcttggaggtgtccctgcgataccgacagatatgttaatcaaagagccggacaaagggtcgaatgaaaagaagaccgggggatcgggcgatacctaatcgggggaccaagctcaggccggcgtcatagagagcttgttcggtaacaagctccctctgcttcggaaccgacatatctttaagtcggtaaaagtcctcccggtcgtccgcctccacccggctgttgtcatttgcttcggttcggagcacgccccagtgggaagggaagccccaaggagatggagatgatacaaagaaaaactggttcttccacccatggatggacgatggaagatcagtgatgaaggaaagacccttccgggggttgaagagccaccaccttcgggctttaggatggggtcggagcacaaaaaaggcccggaagagcgaaatacgagggttggtcggcaaaagctgacacaacagcgcgaagctgattatcagtcggacagagttcggcgccaattgcgccggacaaagtccgtaataattcagcagatttcggacgaactccgaaatcgggagccgaagacccgcgcgaagatcttcgacatacaacgccagttggcccggcggagggttgttaacccgaccgccggcccctgggatggagagttgaaactgctccgggatgcgatactgctcccgaagccgatcaacgttcggccccgaaagcgaggaaacctcaacttccggagtcgatcgggagtcgtcggtcggatttcccgaccgagctccccgagtcggatttccggccatcacaccagaatcgaacaagaagaggaagaagcaaagaggaagaagaagcaaagaggaagaagaagaagaggaagggaagtccacgaaccggcaatgaacccttttggaagcaggagggaagacgactgccggcgatgactgagaaatcgcctggacagagtttctgcagcaaaacgttgacaatgaggtcctgggtccggatggtcctatatatatagggccgtccgatggccgagatgcctccgcaccgaccgaagcctcacggatgtgcgacacgtggtggcctcgggccctcctttcggcctgatgactcggcgcgcccatcccgggacgaccgcaccgccctcattaaatgcgaggggcgccggcccaaccacccccgacatgtggcaaacggggccgcggttccgtattaaattgtccgcggcgattcgcgtttccgatgggacgcctgatagcgcaccgtgacgtccgtcacgttccacagaaggcggcggatatccgatcgtctgacaccgaatcatccggcgcccgacctcctgacgccgacgtgatgtctgacgatgataagatgggatgtctgacacctgacaccgacgtgacatctgacaccgactagacgtctgacgccagcgaatcgcttggcattcatgagacgcctgacatcgtatcaacccacagtacagtcggaatttggcatacgacgaatccactccttttcgcccggggttgctgcccaattaaaagcatcggccagctcaccgtccgactcaggagtggaggggggcaactgttggggaatacccatcgaccgaccgaccgatggccggagggaccgaccgaccgaccgaccgactgacggccggaccgaccgaccgacggtcggaccgaccgaccgaccgatcgactgacggccggagggaccgaccgaccgactgacggccggagcgaccgaccgacgggcgccatcaccggccgattaacggcccacagccgattgaggatgtgtcggtcggacatacttttcccgaccgactgaacctagaagtctgatggacgactcacgtaagactcgccgaccaacagaggggcccgacgccactcagctggccaccgacctagggtcggtcgactcctccgatcgccgtacagccgccagcgcttgtcagttctgacagcaacatgcggcacggccccttaggggcattgtcccgccgagggcattgtcaaccctagtgatttgacagccccacggcgatatgacattttcacggtgactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcgtcggaggatccccatcggagccgcctccggtcagtgtggactttccttttttgcaggcgctcgttccccggcgatcagacgatgaggcgattggccgcaacaagtctatttatatcaaaaaaaaaaatcgatccgatcggcctgtcaaaccctaactgataagctaatatagaccgatccaaccttaggcattatctctctacaacaaagcgacccattgttgagtcgctgacctgatattgatccatctagttgacccactagtattcattggttcgattaactattcagaggtgtgtttcttgatcggattgatgttgcggattcattttaaaattctagttgttgatttgtaaattatatttttatcattatcaagaaattaaaacatttatattccaactttcaaggactatttttcgtatgcccttcttatagatgttagctttaaaaccagatggagtaatgcatccaataaggagtcaactgacttccaggtagaaaggactactttgttgattgtatcgttgaagaaccacgatctgtcaaatttgaagtagccttttctgtattgaggcaggaagaaagtgaggctgataggtgcacggccagaacaagagtttgaaatggccatctgagaaaagaaggggcatagatgatcacatctcgtggaaataattaagaacatggccaagtttcgccattatggaaaagaacggagcactccatgatccttgggtgaagaaatatcaagaaaaatgactttcgccattatggggttctcaccaccgttaattggtcaaccatttgttacatatttacataactttggctccttcattatgtgatgtaactaaaaggatgattatataacggatggttacagtctgccagttgaataaaatctgattggaaataagaaaaatgaaaaatctaagattaacatgatagatggccatgatcataaaggaacgaaaattgatgagaataaaatccaattaaacggggctgtgctcccaagagcctgtaccacaattagctcatctacatggtatcctttagttaatttatacgtgaaatcctccgggatatgtcatcgcaatcttctcttcggcagtttttagaagtgacagctagcttctggtcagaatatttcagctagaagttatttgcgtgaaggaatcgacgcttgagcaattcataattcatgattcataaccatcttttagtctaatttttgctctctgaaatttagagattgctgagattatcttagtaatgcccatccactgaactggttagatgtacatattttatttagaactttgaataacatgtccactctaggtcctctcaccaatatccctgagcttcctttgcacggccaatgatcacttgacatgtcacgtattatccatctactaaccaaccatagccatgctttgcaaatccatagtggcacgcatccacatctttttggctcgagagatttatctggtgcaagtcgtccatcatccttctacagtggaataattaaggggtcaagtactttagacttctcaagtgatcaattcttgcatccatcaatcgccagccgcgttcagttcatacaatctgcatgaagaatgcggctccatgcacaggatagatgattgatgaagggatttaatatccattttatttctagtttggtttgcaaaaagatcgggttatgctaagcgctgcgccgccaggcgctaaacaaagcattttcccacatgaatttggcattgacgattgaaacatggcgacatctcaaaactgttggggatgccgtcgctggtacttggaaggcgaggtagcaattgggaagaagagtaggaacaggttgttatcaaccttcaaccatttcctttgccagacttcccttcggatcaagtcgaacagcctcttttacatcatgataataccctgaaaggtgtagggttcgttttctttgctccctttttttatagttaggattgaactaattacatgtttatttaagattggccttgttgcagtcatatggcggctaggattttaacttgtaattgttgattatgacttgaatttggtgtgacccgccgtatgaattcgatccgttttgatttgtgtacatctgaacctcctacaagagctagttttgtcttatcaactaattggatactaagaaaggaatgtacggaaaacatgttaaagatgtaactatatcacctaatatttttttacaatatttttgagaaataaactttttttttttgacaatttgaaaggctatgtcgtggcatacttttttatttcctaccagatatatggtggtttagtttttctaagaggtaccttggtggttctgaggtcttttgttgactaggattatattattaccaactgctgatacaagtacgcgcgcgcgcgcgcaacacaaatacatagagagagatgagtccatgatatattatgctgcttaaattatttttctatgttaatttattgcttccctgctatacatgaatttgatagtggctgcttgcatttcctttggtgcaactgcatgcaacctctgcatcctattctcccatctgacaacatagtcaagtctttctggacacctttttttcgataatagagttgttgatacccaactcttgccaggttggttctagtgggaatcttatcattgtagcttaaccaaaaaaagatcttaattaacttcaactactgtaatactacatgcgtatgttggtttataacttatccactttccttatttagcttgatatattactatttatggctgattcctcttgtctaatttagctttttgatacctcactgtattttagtgatcattccttatatgatatattgtacattgtaccgtacgtacctttagtttatcggataacataatgtaatattagctttttagttttccaccaatagtttgtacgactcatttccggtatatttttcctctctctccctctccatccttctttttatattaattctctctggagttcattgtttcttcatctctccctcgcactactaactcttcctgagatccttcagctttggaactcttaaatggaaactttgaaagggacgacgtggatactggtggtggttctcttgagtttaaggattggagtgctggatgcttctcatgtggtgcaccctcatctccggcccttacatgtccccgttaccaactcttcgttgaggtctggcaatcacttccagcctcccagaaactgcatgaatggtgacactcccctccctctttccaacatgctgcctcttcttctcctttggttttctgatttctccaccacttatatatctcggactaaaactattaagtttgcctttttgttttttttgtttttttttggttaacttaattaagacatttgatggagtcaaattttccatcctatctcttattttgggttttttctcgatcctattctttgctttaggttcttttatttttttttttatctcttgttccattttagccgttggatgctgacattatgtgttgtttccacgaacgcaattgacgtggcgagcagatccaaatggtatgcaacatactcatttgtcctttattcgatcggttttatcgatgaccaattttaaacatgattaatgacttatacacgcaggaccaatgcattataatggagaataccatctattctatcagtgcaaccccaagggcgcggtgtgggagtcaggcaacattgtgtgggggcactcggtctcggtggacatgatcaattggatagagctggagccagatatttacccgtcaaagccattcgacattaatggggcttggtccggctccgcgacaattctcaccggcaacaagccagccattttgtacacgggcatcgacggagccggacgccagctccaaaacatcgcgttcccgaagaacttatccgatcctttcctccgggaatggatcaagccggataacaatcccatcatcttcccgtggaccaaggccaaccaccctctacactcatccaagaacaccggcatgtgggagtgccctgacatcttcccggtggcactcgggggaaagaaaggattggatgcgtccgcctacgggaagggcttgaagcatgcgctcaaggtcagcttggacgtcactgccacatctcgagcccaacatatgtgtgagatgcaggatgatcgtacattctttagagcaaatcctaaaaaatatacgaggtcaaaaattttcattacaacctcaacattcataatgattaattttaataataattaataaaatttatataattataaatttaactcctttaatcatccgatccatatcaatgatgctctatttactcatccgtgaatccaaatcaaaatcaatcacgagtaagaatttccacacaccaatacgaatataataataataaatgaaaaaataacaatgattattactcatatcaatctcatgccaaaagattccacgattcataaaagttgtatagcaaatatttattttttttacataataaatcacatcttataattattttcagacaatacacatcaaatatgattatattaaggtgctcgtctctagattaccacgattacgtatcgaggtcgtgataagataataaaagtgcctagttctgtggactattacgatcattcgtgcaaaaggtaacaaagtggctagtcctgtggactacgacaatcacgtttcaagcccatgacaggcataaaaaaaatagatagtccaaaggaccacagatgctcaactctaaactaccacaccatgtttcaagtccgtggcggggtctcataaagtggctagttcaaaagaccacaagtgctcgatctgaactactatgaccatatttaaagcccgtgataaggcaccaataaagtagctagtctaggagagtataagtgctcaaccctgaactaccacgatcacatttcaagtatgtgataagagatatcaataaagtggctagtataaagcactacaatcccatatataattacacaactcaattataaacttgtcagatattataattcacaatctcattcttttgcaaaacttgatgcgcatgattacgagaatccatccaagtcaatatcaatgttatgtcatacataatttcatataaaatcatacatatacttaacaaataagtatataacatgtaactataaaaaataacataaatcaaaatcatcgatgcataaaataatttttatataaattgatgattaatgttcaaaaactcttacctttattcatgattgattcaacataataatcgatgaacttttcgatctacgaacttagaaacaatatgtttcgacacctcttcgtgtaaatagtcacacctctatatgatcagaattaaacataaaaatcataaataattagaaacgataaaaaattaaagtaaatctctcaacatcataagtttaagatccctcttagagtccatcaattggtctggttatctaagtatctagatccttcactgatccataagatttctagagagagaaattcataaaaagagagaaaaaatttagagagaaaaaatagagagattagagagaaaaacttgtagagagagaaagtgaagagagggtagagacaggagagaggagagaggaaagattagaaaactctctcttttctttttctttttctgtatttttttttcttctttttttcttcttttttcttcttcgttgaaacaggggaagaggaatgtttggaggccggccacctcccatggtggcgaccctttggagccgatgctgatggccccaatcctcgacgaccacggcaaggccgcatttgatgactacaatcagtccggcaactacagctggtccgatgagagaaaggaaaagaaaaaaaataaggacggctttctccatggaatccaacggccacctagccggtggaggcatcaaagaaactaggaagaagaagcagaaagaggggaagaggccatacattgtctccagtgaggtgtttgggtctctttttggatgaaaactagcgacaactcgttggaaatacatgaacaaaaatcaaaaaaatccaactaattttgctggcgatttaatcggagattgggttgttaagctaaaagaggagtgttgtggcctatttataaccaagatctagacctcggttgagccctagatctcccgatccttaccgaactaaggcagaggaggccgactcccatcaggaggtctcctctttcaaatttatttatttattttttattttttgcttgaggatgtgtgtaggaattcaaaaaaatcagagtccttacattctcccttcttaaaataatttcatcctaaaaattagcatgctgtaaaaccaaaatcttaagaatttaaaattcttattttatcgtcgagctcctaaatagccttttcatttgaaaagaaattccaatcttctaatataacatcctccaaaattagaactaatctttttgatcaaatttaaatgacttaaaccaccacgctatcgctacgcactttgatttaatctaccaaatatctagggtttgctatataacttctaaaccaataaaatagtagattgttaattcctcaaactacaatccaaaatacaaattattcatcaacaccctatggatcatttctatcataatttctagtattcataacctcaagtttctgataccattatgtcatatccttagtgatcataatcttatactcaaatatcttttacgatctttacagatcataatcttaagttttgatattattctatcacagtctctaatgactttaaacctctgatattatctatcatattttattgatcataatccaatattttgatatcacttatgtcacagttcctagtgaccttaaacttaagctctgataccattttatcacgccccaagcccaacacctgagtcggatacatgatgaccgcacactccctagagcaagccttaaagaatatacaagacttaaaaatttcattacaacctcaacattcataataattaatttcaataataattaataaaacttgcataattataaattcaattcatttaatcatccaatcgatatcaatgatactctatttactcatccgctcatccatgaatccaaattaaaatcaatcatgagtatcctgccactttgagaagaaaaagagaaaaggaggagagtgagctttataacccaataaaaattttcacacaccaacatcaatataataataataaataaataaataataatgattattattcatatcaatctcatgccaaaatatttcataattcataaaagatgcatagcaaatatttatctttttgtgtaataaataacatcttataatcatctgaagacaatacacatcaaattcgatcatattaaggtgctcggctttagactaccataatcacgtatcaagcttgtgataggcaataaaagtaactagtcctgtggactaccacaactatctgtgcaaaggataacaaagtggctagtcctatagactatcacgatcacgtttcgagtccgtgacagatatcaagacagtagctagcctaaaggaccactgatgctcaactctgaactaccacatcatgtttcaagctcgtggtggggtctcttaaagtagctagtccaaatgactataagtactcaaccttaaactactacggccacatttaaagcctgtaataaggcaccaataaagaggctagtccaagaaagcacaagtgctcaaccctaaactaccacgatctcatttcaagtccgtgataaagcatcaataaagtgactagctcagagcactacaaccctatatacaattacacaattcaattacaaatttgttagatattgtaattcacaacctcattcttttgcaaaacttgatgcgcatgattaccaaaatccatccaagtcaatatcaataatatgtcatacataatttcatacagaatcatatatatacttaacaaataagtatataacatataactatcaaaaatcatacaaatcaaaatcaccgatgcacaaaataatttttatataaattgatgattaatgtcaaactcttacatctttttatggttgactcaacataataattgataacttctcgatctacaaacttagaaacaacatgttccgacatctcttcgtgcaaatagtcacacctctatatgatcagaatcaaacataaaaatcatatatgattaagagtgatgaaaaattaaaataaaaacctctaaacatcataagtttaggatcccccctagagtccatcaattggtctgggttatctaagtatctagatcatctattgatccataaaatttttagagagagaaatttataaaaaagaaagaaagaatccaaagagagaaaattctaagaagagaaaatagaaagattagagagagaaatttatagaaagagaaagtgaagagaaagggtagagagaggagagaggaaagagagaaattttttttctttacctttttcttttctttttctttttctggtttttttttcttcttttcttcttcttcgttgaaacaagggaagttggaggccggccacctcccatggtggcaacccttcagagccggtgctgatggccctaatccttggcgaccacgataaggccgcgttcgatgactacaatcagtttggcaactacagcctctggtgagaggaagaaaaatgcgaaaaaaaataggggatggctttctctatggaatccaacgaccacctagacgacggaggcatcaaagaaactagaaacaagaaggagaaagagagaaagaggccatacattgtctccgatgaagtgtttgggtctctttctggacgaaaaccaacgacaactcgtcgaaaatacataaacaaaaatcaaagaaatccggttgatttcgccagcgatttgatcggagattgggttgtgatgctaaaggaggagtgttgtggcctatttataacccagatctagagctccgttgagccctagatctcttgatccttgccgaacttagtgaaaggaggccgacttccatcaggagtcctcctcttccgatttctttcttttttttttattttcttttattttttttgctttaggatgcgtgcaggaattaaaaaaaatcagggtccttgcagtcgcaaggtttgattattatactgtgggaaagtatggccatcctcatgataagtgtgtgcccgactacacatcaccggatagtagcacagggctggggatttattatggaaatttttatgcctccgagacgttcttcgatccagcaaaaacagcggaggattttgtgggggtggtcgaacgagtcggaaacagctccgaatgaaaatactataggctgggccgggatacaggtgagcatgcatgagttgttcttagcttcatttatgttgattctatatgttatatgaggtagtcgatgacatgaatgttgctttctagattttattctaaaaatgttcttattcgctttgttctttctgttgacttttattgtgttaggccattccaggggttctttggcttgatagcgagccaacgacagcttgtgcaatggccaatcgaggagcttgaaagtcttagaacaaagcatgttcatatccatcacaagaaagcgaaaagtggaaactacattgaagtaaaaggaatacaaacttcggaggctagtatctgttcctattagtactgcgcactactttgaagagttcttacgttttgtctattattccatgctcttatttactggcattcatcatttactctgcattttgctgtattttgttgcaacttcattaatatgttgttcttccagtaaaggttaagctttttcctttttctttttcaatcttggtttttaagctatctgcatgctcctcctactagctttaaaaccatttcccactactgcagtgtattctactttttgtatagccaggggcttgtttctctttgttttccgctgttttaaattcctagaaagtaacctattgttcgagaacctgatctcttaaatgaagatgtcgatatctgtagtagacttaccatgaaatttgtaacaatctacaaatgattatcttattacatcaagaaaaatcaattgattatcttatcctgcatctgttctttatcttcttgtcagacttggaatggtattagttaggttgtcgatctctcgttttatttacaggcagacgtagaggtaacgcttgatgtgtcaagcttggaaaaagctgaggattttaatcccgcttggactgatccgcagaaactgtgtggcctcaagaacgcagaagtccaaggtggagttgggcccttcgggctcctggttttggcttctgcaaaggtggaggagagaactgctgtatttttcagggtgtatgatcccataaggtttgccatccttccttcatccacgttccttgtttctggtcccctcacagagttatggagtcattgaccgtggctcatcaaaaagaaattacagggtaagcaagagagcacaagagctcattgtgatttttgtgacatataaccaccaccaatgatgcataatctaaacgcatcacacttgaaacagatcacacaattggtctccacaaaatcgccgtgctcatgtgaatcacactataagattgtcaagattatgtgatggtgttgtgtaatcaaaatatgccatttcatcttgatcggagaggtgtttgtgttcgacaagcaaatgcagaagtctaccttgttgggttggattttgattgtgtggctggagatataaaagcattctggctcaatggtttgcgccaaattgaagtgtaccgcaagaagacatgccgacacccacatgtctattgtaaaatacactgctctttgacaaataagtaattgctgagataatattagtcaatgtcactaatagtccttgttatatgtataggtcttctttagtgccacgtgtctatgaaccaaccttcgctggctttgttgatattgacatagcgaaaactaggagaatctctctaaggagtttggttatgttaatcactctcttcatctacttatgcttttttgatcatatgttccctttaaatcttttttttttttttcttgatgatatatgttcgctttaaaatagttcagtgaaattgtcgaaagatacttttcacatttaatctcctgttacctgtttatatgcagattgataactctgtggtcgagagctttggtgctggaggcaagacatgcataacatcaagagtttatccggcattagcaacaggaccggatgcacatctgtttgttttcaacaagggtttagaggacataaaagtttcagagttgagagcatgggagatgaggaagcctctcatcaatgcagggtaacgtgatatcttgtgggctgtataaaatatgttgtcttgcactcataaaacctgattagagcttgaaaataaggttcgtgttttttgatggaagcattgacttttcttaaatgaaggattcataaagatggaatggtatattttcttttttggtaaaagtcgaattgaatgttagacaataatttcatgtggaatttctatttaaagtgatgcgatggtaatgtatcaatacaaggatttgcatttctgtaacttggctgtgcattgtaccgcagactcaaaaaggtccccttcctttccagaagcacaagtgagtagaatcctgcccataagtagagctatgccatactcaagccttcttcttaatgttttctgggaaaatccatctatttgtggttggatttctgaaaactctgccagagcatgcaaataagtaaagtggtacaagatgtgccaagcctatccgaggaaataaagtatcatgatttacacatagagtgcttctaaaagcttcatgaccatttgcatagacttaaggtgagatctcctactttctggtgagaaggcatgtttccttcaagttgcaagtactaaaacaatcgctaactgcatgccttctagtactgagtcttttttcaaggtctcatttcctgtctatagctatgatacggaactctgaatcctagcatgagaattccagtagcagtcaagttttaacactaacttattacactagcaagtcaagttttagcatcgcaagtcatcccagtatgatatttgcaccaacatatctgttaggtataaaatatctccggccgaagttcgtaaaagctgattctttcaaaaattttttggcttccgaccttgtatggcatctttctgaactccctcgactgttcgagcttccataataccatccggactttttcgataatgagctcctccattcatatactggactgctccaaatgctctccgaacttcactatcagccgattttctataatgatcgactattctccgaatctctttcagacttcttccggccacgaacggctttactctgaacttctttcagacttcgtcaatgtccgagcttctccaacagcaagacttctacagtaactagactccatccaagtttctacgacggtcgaccgccttccagatttcatccgagctcctacaagagtcggatcccagccgaacttttacagcggatggattccagatgaatttctacaacgagcaggctccaccagtcggatctctactccggacttctattgcaagcggacttcatccgagcttctacaacaagaagtcttcattcgagcttccacggcaatcggtcttcgtccgagcttctacaataagcggcctcctttcagactcctacaaaagtcggactccgtccgaacttctacagcagaattgaatccccgactcctccaacgttcgatcttttccagtgtcctcgagactcctctagcggacgaacctccacagcgccacccgaactccactgtcggacaaccctatgtcggattcctcatgaaatcgaacctctccgacggacaatcttcagacgagcttccacatcaggcaaatttcaaatggactcctctagtgatcggactcttaccggacttctccaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactagtgtgctggtggctttacccttcatattaaagacaggcgcctggcaaaaaaaaaaataggggcctggggcggtcgcccgctttgacccggtgccggcagtgtgtaccaatacaaggatttgaactttatatgtccagagtcaattccttgagacgggtgcccaccacgagagctaacagacgtacgaaaacaaacacatagtgaaaaaatttattattattatataaattttttaatcatattatttatagttttatctttattactttattattattatataaatttttttatcatactatttatatttttatttcttatttaaaaaatataaaaataaaaaataaaatttaacatatggtattgtgaaaagttatcctataattttgtgtcagcttggaatgccactctaatacctgtgtattactttactattattatataaagattatataaatttttttttataatattatttatatatttatttcttattactttactattattatataaattttttatcatactatttgtacttttatttttaatttaaaaatataaaaataaaaaaattgatacgtgacgttacaggagaatatcctataatcttacatatcaatatggaatgacatcctaatatccttgtattactttactattattatataaatatttcatcctttgtcatctacccatctgcacagatctcaaagctcatactttatcatttatccattggcacaaatcttaaagcactactctttatccccttcctttgattcctaccaaaaaataagaactccttgctaagttagtaggaagggtagttccaaaattttataaaaaaattagttatcatttgatccttgctaactatctcctggcgctgcttccgggtcatcactggcgttcccctctttccctccaaagatggttggccgggcccttctttatcctctctctctctctttcttgctcctgattgatcggtccctgaccaaacatctctccctcttctttctttgctaatggattattgtcgccagtcttcctcaatagtgggtcagttgcctggctctcttctcttcttagagttgttctctccagtatggctggctggacctcttctttctcctctgacctcaaaggtttttctttttttgcctttctctttttctctcttatcggattgaggatgaaaagtggcttctctctttctcttatctcttcctttactaatgttggatggccactgggcctcttctcttcggcccttcctctcagtggcacctagatcctgcgagctcgttgccggttgggccaacataggtggccaactaaatggagcttggccaggtgccctttgtctatcctcttccaacgataatggttaattgattggttaactatatttcaccctggacagttgcaaggtggaggcttcaaatttcaaaattttgattgtacggaagaatttaaatttcaaatgaatgttggggggaatgagatgttggtgggctaatttctctctcatgcacttgcactttctcttgggtgaattttttcctccatttttataaaaaagtaaaaaaaaaggggagacaagatgccacatggtgtaaggcttatgttacagatcgccaatgggctggaccaggccgagcacaactcgagcacgagaaggcccaaaactaaacagatagtatctgacataaaaagtgaataaacgagttggaccagcctaatccgttaagcaaaccccctcgtggcacacacgtgtgtgcttgggtcgtgccgaacccgtcagacctatttttaatttttttatttaatattaaattttaaaaaaataaaatttgttaggttaatatttattttttagatataagaatttattattgattaattaaaatattaaaaattaaatagtaagtatcatgaaacatattgtaaataaaaaaataataattaaaaagaagaagaaatagttatttaagttttataatttattattattttaattaaaatatatgttaaaaaaagttatgaaaaaatatctcaaaatttttataaataattgaattgcttgttgtttaaattacagagattgcaaaaatttaaaaaaaataattttaaaaaatatatcataatttttgtccaagtccatcgtgctagattgggcacggcccatgggcggtgccatgcccagttctaaatgggctcgtactgtgctcgggtctgagctcgcaaaacttagacccaccacggcaaaggggtatggctcatgcctagcatggccgttattgttcattacgaatcgtaccaagtacggtccattttggaccggcgtcgggccacgtatgggtcgcccaatctgttggccacctctagcttatgtacagaataatatttacaggatccggcaactgaaggtgccttacgccttagagacccctagttgaaatactaaagatccgctggtgaatcaagtggagaaaatggtccacctggaagtcttttagttggagttgctgtatgcatatccatgcaggtgagtgttcagtcccaaacgctaccttcgtgtgctttaaaactagccagggatctcaaaaaaaaaaatcctttattttttttgatgagctctgtgtcactataaatggtatctaactctacatatattataataataatataagtattatttttatttatatattataataataatattataagtaaaaaataatggttcttatttgtatattcttaagggccattataataccaaacagcatattataacagctattcccattattatacatataacatgacataagataacatggcatcatggtttggggctgaaattatcataacggttgaggtcacaatctacttcaacccaagccaaatggatccgagggaaggatgaaaagaagaaaaaaaaaaaaaacagaaaatagaaaaggacttgaatggaccatgttttccagcagtctgataatgtgatcaaatgtatgcgcatgtatcacacagaacatgcatgatctcgaagtcacatctatgcgctccaagattacatcagtcttgatttgatcttgctccataactaacaacgagggtgacttgaaagaatctttcaccgaaatgaaagattgagctaaatctgctcctttccacattgcacatatcaacgtccgcccatgcaaacctaatgaaagcttgatgtcactttggatacccctttgatttttcttccttcagatccctccttttcgtaattttatttaattatggaatgtaaggaggtgtccactgagagagtataccattttattttaaataattgagaaactcactagtcaagtttctcctcctcgatcagatcgaagagttttaatacttttaccagtttatttctccaccattatttgatactctttaaatttgtcaaagacttcgaatttgtatttcattaaatacatatatccaaacctaaacatatcatcagtaaatgtaatgaaataagagtatctacttctgacttaagtcgacattgaaacacaaacatcagtatgtacaaggtccaaaatgtcactcgcccttactctatgtccagtaaatggagtcttggtcattttaattatgcgacaagattcacaagttctatatgattcaaaatcataaggatcaaagaatttatttttgtataacttgttaattcttgacttatttatatgaccaagtcggtaatgccagaggtatgtgacattcacatcctctctctttcttttcttcgtattatcaatatcaagtacattatcattaagtgataggaatagaaaatcattatcaatataagtatttgcataaaatttattagaaaaatagagagaacaaccattattctttgcttttatttcaaaatcttgttctaataataaaagtacagaaataatatttttaacaatattaggaatataataataggtctttagtttcaaaattttattcgaaggcaacttcaaaatcttggttcccacggcttcaacctgaatggactcttcactaacgtcgaatagctcgaagtcacatttattcagactctttatttcctacagatcttgcaacgatttgcaaaagtatgagccacaggcggtatctaatacttaagaatttgaaattgaagtacttaatgataagtaagtttgtattgtatataaatctttagcaatatttgcttgtttcacagttacaagatattccttgcaattcttcttccaatgctcctccttgccatagtgatagcaaatacctttggtggagaccttctttgccttcttcttggagatgccagccttaggattcaattttttcttgtaacctttttttgtctttcatcttgttgatcttatcaacaaaaaaaactgaaactttttcacctttgaaatggctctctgttgttttcagcatgttcagcagttcagacaggctgatattcagtttgtttatatggtagtttatgataaactgagagaaaaaattggaaagagactgcaggatcaaattctgactgagttcaccatccatagtgaaatccaattatcctagaggagtgatcaaattaatcatctttaggacatgagtttgcacagacgtaccttcaaccatgcggacacgtaataactgcttagatatctcatatctaacagtttgactttattccccatataacttcttaagattaaggagtatagaaagaacatccatgtccttatgctatctctaaagcccattgttcatcgagacaagcatgatgcatttgacagtcacactatcatccttccacatcttatatgtgtccctttcctccttagatgcatcttccttgatattatcgggtgcaggtgtatccagtatgtaggagattttctcttgagtgagaacaattctcagatttcttaactagtccacatagttagatccggtcaatttgttagcatcttgtatgccttttaatgacaataaggatgccatatgtgcagttaatctacaatgattagaacacaatataagcggacaacttatgatgacatgcataactagattaagatttttgtctaattgtgtctcccactattttaacgaatttcatagccctcaagtatgaaaaatgagaaacatccttatgtttctaagtagggttgagatctttattcctcacaaacaccttgtggatagcacaacaagcatttatgagttcaagaataggtaactctttatcaattgtacttcatacaattcttaatattttttctcttgcctctagatcactcatagtcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtcatagttgaataatactgtccttgtgaatagtacaacaaagcaatactattcaaatatgtcataagcatcaatatgcacttaatcaacattatatcaatttttatagtaagttttgtgtatagcacaataagctcactaagatcttgacatactatattgatcaagcttgaaggaaggcccttatagtatctacatcactaatcaatctaagttcaaaatttaataagaccaaattgactaggttagtaggtgggaggctcctcgtagcttttcttagacaccaacaaagttggctaggccagtatatggatctaattagaaaattatctttaacacttatctggacaccaattgatcaaataaattcgatatttgatttgtaagtgaatctcgatattacaacttaatataattttatagagggtctttaaattgatctcgacacatcctaactataattacgtaaaatatactgtatatattatgcaattcgacatgcttttacaagtcataataacaatcatattgacatgccaaaaaatcatataagggtgcataaaatgacttaacaaatataacaagtttagccaaattgaataacagaccctaatcaaattaggcatgcattacacccttaaacatgaaatcgatttaagtatcaagaaaccatgaaactataaatttcaaattatcataaatttataatcttaataactaaaatttaaatccaaggttcaataaagtcaaaaataatttttgattttaagatcgatgttcgaaatcgatgcaatatttttgacaatatatgaattagaataatttcaaattataacttttgtactcgtttgatcgaatctatcaaggatagctctgataccactgttagatttcggtcatgcagcggaagtcaaattttaaaattttaaagcaagcatatcgaaagctttagcaattaaaactatcgaatcgaaatctaaatcctaaaatcatcttgtagatgtcgaacaaaataaaaataagcatacaaagagatagaagtttatacttcctcccaagaacagaatggtaagtaggtaatctccatgagactccaaagtagaatctctccaatagtaatccacatgaaagttggtcaaggtccttcctaaccggtgcactgttgcagtcttttctacgcaagaatactaccgacttcgaactcaaagtacgatcacaccaatatccagttgccttcgattttaccatcagaattatatcaagaggatactttttagaaatctgacaacctaggatttgattttaggctccaacatatagaaaaatcaaatcctaggataaactagcaacacttgttaattatctcaccacccttcttacaattttttctctcaatttttctttctctttttctcaatttctttttaaaatttttctcctctattacacgccaattagctctaatttcaatccaaaattcagcccttagcccatataggatgctccatataaataggctaagaggggacgtgaggaaggactaagaggcaccaactcttggcgctccaacttcttcacatggagaaattaatctccatgattttatttggtacaaaagagccttcacacagaaggactcctcttctatgctccataaaattttcacgtaaatatagcatgtaataattaagaatctaaataaaaatgaagagatagataagagtctttatgaagaaggactcttcacttctcaatgcaattaagaaggggggcggcaattattttttgtgtgagatctggtgggtgcagaggactccttccacacttgaaacacttctaagttagataagaaccaaattaaataagacccaatcctattaggtcagaggtaactgatctagtttagctcaaacgctttgaactgaatctaattaggaacttgggttaatacaatgtgctagtatatcaaattaacccttaagatttacattaaatcctaattaaatcagatcaagatcaaatttcaaagtgtgtgacccattagatttcaaatctagccagcagtggacacagactcttgacgcaatcctaatccgattagattaggtcagctaaaaaatttcaatctactaagactcttcctaattgattcttgaattaaactcttttaattttgacgagtttacaagtcaagattgatgtctagcaatacgtcgtgactatccgaaagatttaaaattttgatgaaaaattatcaaaatatcctttagtggtaatttaccttgtaattcaatccttcagtcaaacattccagatgagttgtgggcatggaatcatgtcaaattcaaatacttatctatatgtatctcgattaaaagatgatgattcagttgatgatatattaaaaatctctttctaattatcatcctgctttggccaaagacttccagaatcatcatcctatgagatcacataggatgttcgctcctcttattaggagtaattgatttcttgttgacctctcacaacctccatgcacacttcatcacatccagaacaccccacacaaggatcagagaatcaagttagaaagtgaattaaaacatggattcatgtacataaggtaccatggcaatctcaggtcaaaagatcacttacacaacttccagtagagaatcatcagttgatatgtaaataaaactccatcaaatattctctcgcaggtctattcagcgaacttattttctaatgagtacccacatctttgtattagtgtcgctacataagtggttgtgagatcaaccatcctcatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngccgcccgccggcggtcctctgccgcctcgattctcatgccgacttcaaaagctcgtatctcctccatccgagctccgtttcaggtgatcttggtctcgttggactccatttttcgccgcgaacctcgctgtgtgctcaatgtgggctgaatctcgaggcgtcaaatcctaacagtgcaaggtgcgttatgtttgttccttatttttgatgcaaggattaaactaagtacatatttgtctaagattgagattattgcagcagtctggacatggttgtatggtgtgtagtttagcagcagacgtgtggagactctcctttcatcgattactttcaaacgactccaacaggttactcccttggataccctaccctgcctaaagatttatatttccactgcagtgtggacgacagaaaacttgggaatacctttcaaatggaaatcactgtcatggggattacccagccatctacaataaaagaacgcttgccgaactgatagagaaatgctgcagtcaaatcatgctcagtactgaattagttttgtatttttctaccaaagcaaattagtcttgtatcttggcatcagatggtccctgatatatttaagaaggaccgtgctggccgggctggctttaattttgtcaatttccactgcagagtggacaacagaaaacttgggaatacctttcaaatggaaatcactgtcatggggattaccctgccatctacaataaaagaacgcttgccgaactgatagagaaatgctgcagtcaaatcatgctcagtactgaattagttttgtatttttctaccaaagcaaattagtcttgtaccttggcatcagatggtccctgatatatttaagaaggaccgtgctggccgggctggctttaattttgtcaactcaggtaagaatatttaggcatacagatggaattgttgatgcaatattagatttattatctgctcaggtaaaggattccctggcatcttctcttgttacctgaagtataataatattttatataaattatttaagtatgttttgaattgcatacattatgatataatcatgttttgacgatataatttgattaaatagattaaaatctgacatgaaatagagattatataaaagaggcaatgggctaaccatgttggttatggatagccagtcatggataaaaacatgatatatgaattaacaaatatggacagaaatttgatatgtgaatagctagcaacgtataagaacataacatataaataatcacggatagaaaaatgatacttgagcagctagccacatgcagaaatataataaaaatcactgatcataagcagaagtgtggtgtgctagtccaatattaaaaagataattggatgcttggagattgtcattgaatatcacttggaataattgatgaaaagatagttaattgaaaataactgagataattactaatgttagcatattttgatgcattttggttctaccagatggcattcatattttgattattgcttatttgataatatatatatgtcataaaattatcctcgataatctcaatagctatgtcaaatattttatgtatatcattgcattatgtatattgatgtacttgtatataggatttctaaccaagctggttagctcatattagttgtttgatgatttctttttcacaaccttaggagcatggtacttggcagaagttggatctactagcgagagatggataagagaacaaatctatctaatataactagatgatcatgaatttgatgataaattttgttgtgtaaattgtctagtaggctttgcatattccatacacgtcatgtggttaacccgggtgctgagtttggagcatgacatattagatccatgctagcctagaaatggatattagaccaccttaaaatgtactactatgtttaaactagagtctatgcattccaagaacactgcatatatagtcagtcagctcaaatgctaaatgttgcatgaaaactgatagttggctcacggcctcttttaatggtggagatatcacctagctgaacactaaacgaacataggttcacttgcaaggctgcttacttttaataatattttaatgtaataatgcactaggcaataattcagaggttttgagagaagacagaagttcaaagcttgaaggatgtttcctcaaacatcttggctaagataacttgatagtagttctttgaaatgattggtgacatcagtttttctcattatttgtaaaaacttgtaattaatgttatctaggtacctcaatgtggatgcacttaaaccatacaaatgaaatgaagctttcaattatgttgttatcctagcatagtatagcccataggctactattgttattgtttaaaatagtgatagcaattcatttcttcaatctaaactatgaatcgaggggtacctcaatgattataagctatgcttaaaaattggaggttttgagtttcactgatggtgtacatcctcaaaatttaaccatgtaattatatgtgacaaaacttcattctattttaagatggttcaacttaaaatttaccattcttttatttgttatatttataatgattcaggatctcatctaaaaaggctaactaaaagatattatttatgttcctttgttctatataagtatctaagattttttcaatcaataactaatataaaatttaatacacgtctgcatggatcttcatatatatactctccatttaaattttggcattctcactgggttaagagtccaacttcatgtatccattcataaacactatgactgatccatagtcagtccaattaatccgtgccgcagtatctcttgattcatatgagctatgagccagtccattctgatatcatttataacaactcaggatctcatttagaaagactagccagaatataccatttggattttttgatcctgtataactatccaaaattttctcagtgaataattgaagtggggactaaatatacacccatacgaatctttgaaatattgattatttttgtgctataatgataagataatgataaaaaatcataaaagtatcttcaatttttgattttcaataaaaaatgaaagtcatggtattaattgatcgacatggtattagttgacagaagtattttaatacactccatagtacattatcattattatttaacatttgtgtctatagcagtctcttgttccatcacattttatcatccaccaatattcatagctcattgattggacaatagacctgtctgttacaagaaatagctgatccacttttgttctcatgttcataagataaaaagggttttaccatttaaattttcttctagaagtaattaatgtgatattgtatttgcaaatcattgaaaaaataacgttccatttgccatgtgacaggtggggcctgactggtgtcctatagcggtgaattttataaagttgtatggttctacttatatatcgaagaaatagttattaataatgttaattagagcaccaaatgccgctaaatctatgatgaacttgaaacatttagtgattttttaagcatatgtagtattaacaatgaatttgggactcattctagatttttaaattttagcagtaagagactcttgatccgagtcttggatggggcattttgacatatttagatagggattttaggccccactagaccgtaaggaacgtaaaagaaaagtcatactgccattgcagaaccaacagagattcctagtggagttcaatcatcaaaatcatgttacggtcccacttcagttgtccaaacatcaaatcctatagctaccgtgacgcaagttgaaaactcgcaccatgcagtagcattatggtgcaagatggtatcaacgtccacttgctctttcggtccacacctaccgtaggaggaaacatggcccatgcatgttcttgtctgactggtaggttgtatctttcatcctttttttgcttttgttagccgttgaattgtacaatattcacttcgagatctatacagatagatcaaattaataagaaaagtttgaagtattttgccgacagttgatatcacgaaaaaagatcaatgttccttttcgcacgaaagatacaacccgaacccctgctggaggatacgcccccacagcattggatttgatgaatccaccaccatgccccaggagaggaaaaatttttgacgttgttcctggactaggtccatctccttgacaagaactataactcatcaagcatggatctccccattttcatcgccgctccgtaatatatttctacttcaagggccggcttatggtggaccaataggtgcttcatgcaaaggatcgagaagctactgaccatatccacgcaagtgcttctgcgcgcgtacgtggaaccacaagctagcccacgtatgtccccagtcttaaccgaacaaatgcgctgtatctgggtgcttataaagcatcatcgagaccatgaagtaacacacgcttacagagtatcttgcaacttgaaattgcagtgaataagctaaagttctggcctcaatgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggtaagcgattccttgcttaccgacatttgtggcaaagcaaatcgcaaaaccttttctatcctgaactgaacacacaaatgatcaaaattgctcttcaattcaacaagtatccaagcgcaagcgtatgaaggagctgttgtcttttcatcccagcacagcctaactcctgattaccttgtctcacatctttacagaataaagctgaagtctgttactcatgggtattagtaacaagagcaactctatgaaaccctgaatactttccctcttctgtactctgaactgggtgtgaagttggtaacttctcacccttttttatttcttattattcctactaaacttctgtactctttcttatatttaatgcaatgactcttgagttaggtcttccctaactcatttgcatcaaaaaaaaaaaagtggagtcttttgtcattcttgagctcattgtgcttttgtggatttgaaggcctcagaaggtgccgaaagagctgccgactacggtggttgaactatctcagccctaggatcaacagggagaaattttcggaggaagaaacagatcttatcatcaggcttcataagctcttgggcaacaggtaacaacaaactatgaagatcgttcattatatatccatttgtttatagagacctttatatttgttttgtcttgagagatgccaatagttttgcttctcttaattcatattccttacctgtaaagtgaaaaaaaaaaaaaaattctgtgagatcattcattatgtatgtgtttgtttttatacagctggtagctctggtggttggcacccctctcctaaggaactgttttatgggcatagaaagctcaaatcctagtattggtaaattaccatcatattactttaaccgaaaataatacttaaaaaattattgcataattttcatatgacaagttaagaaacaatattaaagttaaacggcaattacaatacaaaatgcttcatgccgctgatcaacaaaaggttcattatgtttatgtggcaaaagaggattaatttgattgaaggtgtacgctagctaacgtagtaacatgttggactgagaaaatttagtaacatgttggactgagaaaatttttgcaccactaattaccaaattctagctttcttcttatgttgggacaattaatcactaaaaaaaggataagatggtgcaaatcccatgaggaaccttgatgaagtacaaaatagagcatatttcatcatgtactgagcacaactatcttcagaatttaagctcgtgctatgtgtcttgtttgcttcatagactgtcacactcgaaccctctagataggttgacgcatgacacggccacacactccataagaaattcctagagaatgtgacatagtcaggaatcttcttgtactttgaatgtcccagtataggttccaaacaagtagactgataaatattgcatctagatttagatttaagcgcaagatctttcttttgctgaatgattttactgtattccttttgcagtagcatgtacatcaactcttaaaaatggaatctatgcacttaaacctatacccaagacgttgtgctttaggcctaaagaaaatacacgataatatcaacacattttcagtcttttcgtacaatcgtatatttgatttgttgggtttcattcttgagatcattccacttcctccgaatgcaattggcgtacgcaaccgcgggcctctagctctatttgctattttcatgcatcatgcttctcttgaatctcttgtcctccaagggaccctctctattaaatcatcacagttgaacacaaacaattcaactaatgagatctgaattcgataaatcaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttttggtcagaagatcagcaatcatgtggaagccagcagccgcaagaagagtttggcataccagagctaccgacaatctcagagaacgatgaagcgtggctgaatagtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattttaagttgtttcgaacattaatgctcctgaaattcccacgcaaggatttagagcttcttatcctacaaaaggacaggaaacgagaccttgaaaaaagactcggtactagaaggcatccagttattgattgcttttatacttgcaacttgaaggaagcacgctttctcaccagaatggaggtctaagcttcagtctaattagtaaatggtcatgaagcatttaaaagcactctataaacaaatcatgataatttatttccatataggcttggtcagtctcgtacccctttatttttttgaacgctgtggtaggggtttccaaaatccaaccaaaaataaatggatttctccaaaaatgattaatcaaaaggcctgagtatagcataggtcaactcaaaaatattggatggatgtttgatcaggacatcatcttttaagatcttttcagtaccacacaatgcagcagaaagaaagaagaaataaaacagtaacaatcaaaatacgtggatcagccacaaaagggctcgtctccacgagacatataaacttcactatgaaaaagaaattttataagaggaggtctcatcttcaaccctcgtacacataatttctatttcacggaaagttttgcctcacaaaagctctctcttagaagaccccccctgaacttctgaaacgaccgctgtccgctatccaggagccctgctctttctctctacagcgtaagacagctctctctctcttcttcacagggtgttctctggacttttcgcagtcgtacgaagttaaaacgagccaccacaccttctgttcaccgatcaggcacttttaaagggcttaaacctaattagattaggtttagatctcctaaacagacccaaacaaacttagatcaagcccggaccgttggatcgtgatcgggagctccctgggccgtccgatcacgtttcggtccacagaacagtgttgtggaccatgtgaaatgcatgaaaaatgcccacgcggtccacagatccggtcgtggaccgcctgatccacagtggactggggtacaggtccaagcgtggtgcctcgggttgcatgctgacttcaaaagcacgtattttctccgtctgagctctgtttgggtgttcttgatttcgttggactctattttttatcgtgaacctctctatgggctcaatgtgaatcgaatttcaagcgtcaaatcctaacaatctccatctcgactcaatattcggtctcctcctaactccgagagcttctggacctcttcgccccatgtcctgggacaatcgtctgcggatcatggatggacaaacatgagagtcgagcgaggccactcgatctcattttcgtcgtatgctgtgctcctcctgacctgagacctgctcggggcatcatcctgtggcaataggaatctcaccttgcgacgtcgcctctcatcctcctagtctcctatctcgtgcccgatccacctctacctggagctccacctcactctgagctccacctggctcctgaaactccacctcacactgggctccccgtcaggtaataatatcctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtatcggatctctcccaatctcctcactgcaccatcatgtgtcctccagctgaccatcccaatgcttttgatctcacagctcgattcatccgacagatatacagtaccctcactatttttcagggagtcaaactgctcctctctgcaacatacatgatgggtgcatgcagaatctaatatccactactagaaagaagtagatacctcgtcagatatctctaggacatttccatctgaatcactgctggccgtcgccacagcagccatcatccaatttttgagttaagggcaatctctggctagatgtcccaactcctcacactggtaacacctggctttgttcaagtccctcttggagttggactgccctcgtctcgatctcttgtcgctccgtctacctcctcctgctcctccagaagccatcaaagctgagctactgccacctgagctcgaagctgggttcttcctcccgagaatatagttctggagtatcatcatagtgactttatctatcttgatggtgttcttccccactagtagagcagtcgtcaaggactcgtacaaaggtggaagcgatgctggcaaaaccagtgccctggtcttctcttcaatattctcatcaacgctgaggaggtcagtgaggatcttctgaaagtggttgagatgctcctgctcgctctatcccttagccatctgcagctggtaaaactgtctctagaggaaaagagtgttggtgagagacttcgccatgtacaactcctcgagcttcgaccacggtaccatcgaagaagtctcgctcagcacatggatcaccacctcattcgctaggtacatacggatggtactcaccgcctgcatctgtagccgtttccaatcttgcacctccatggtggttggcttttcctcgcacaagagagcatcgattaacccctgttggatgagcacgtccttcatccttgcctgtcacaaggagaaattgctcttcccatcaaatttgttgatctctatcttgattgattctgtcttctccatcttcagtcttgctcatcaccgttgcaatctacgttcttgtaccacctcactctgataccacttgtgggtggatgtctggccaggataccacctcccaagaccttttcagtaccacacgatgcagcaggaagaaagaataaataaaatagtaacaatcaaaatacaaaaaattttactataaaaaagaaattttacaagaggagatctcatccttaaccctcgtacacccaatttctctctcactgaaagtttctcctcacaaatactttctctcttggaagacacccctgaacccatgaagcgaccgctatccgctgtccaagagccctactccttctttctacagcgtacagcagctctctcccttcttcacaaagtgttctctggatttttcacggccgtacgaagccaaaactagccaccacacattctgttcaccgaccaggcccttttaaagggcttaaacctaattagattaggtttagacgttctaaacaggcccaaacaaaccccagatcaagcccgaaccattggatcctgatcgaaagctctttgggccatccgaacatgctctagttcatggaacagtaccgtagattgcacgaaacgcgtggaaaatgcccatgtggtccacagacccggccatggaccgtccggtccacagtggatcgaggtacaggcccagacgcggtgcccgagcctgggccggcccgcgtgcgcaggcctgggccgcgccccgcacgcgcgcctagttcgagtcatgtgcccgcgcttgggctgcgcgccccacgccgagctgtgccctgcgcgnnnnnnnnnnnnnnnnnnnngcctgcggccgcaccatcgatgctctgccagcctgccgccggcagtcctccaccatctcgaattgcgtgccgacttcaaaagcacgtatcttctccgtccgagctccgtttgggatgttgttgatctcgttggactccgtttttcaccgtaaatctctctatgagctcaatgtggatcgaatttcgagacatcaaatcctaacgaaaggtaggattcatttttacatgtatgtttgcaggacaaaggtacccatttgagtttgcagttagacacagccacttaccaaaatgcagatccttgctttggtacgttaccatcgcattaatttaaataataaatcacatataaaactgttgtcaacaatgatgcgatcgattatgaactacagttagattgataagaatgaagagaaatgtgaatagaacgcatctaaaggtatacaaaagatagaggattggtgtgattcatggcttaaaaaatcttttggtcctacaaataacacattttttgctttcttcttcttcttctttttatgaaaatgagactaaggagttaccacttcgtcatctaatttttgttgcagaagaaagaaagttcacagaggatgggtggaatgtacagtatagcaacgaagaataagaaaggccgtctaaaaatggctagacagcaaaaagagataggcaagccctaacatcatcgattcctcccaacaagtttttttgagattaagggaggccggtaaggcggctacgagtacgagtatttacaataggcttaagaatattgattccatcttcgcaaaatgtagcaaaggctggaaaaccgaatgataggacagcacgaaagataggaagggcgcaaaaggaccaccttttgctcagaaaaaattaagcagaagaatccattgtagtccaattatgaaggagcacgatccaccacagtaacattcgttaagaccttaaggagagcaaattccatcatggttgaagtgagaggcacctgtagcaagagtaaatagatctgattttgttctatactcttccaaatccgagaaggtctttaaatgatcagaggtgagatcactcgttaaagagagagactcatctaagagcaatggttgaggcaggttgctctttgtgaagaaaaatccttgagtttccttcagtctagatactccaaagaattgtttttttgatggaaaagtgaagcaatgaactgccacccagcctttattcagaggggcatgtacaaagggaaaggcatacaagaatagagcaaaaagtaaaatactaagaaggccaagctcctccaaacaagagcattgaggttacagcaacaatcaaaataatagaaatatgctcatctgcatgtgacaactgaatgtaatagaccaggcttgtaccggaacactctcccttgcgcatcttttgtccctgattttcagaattattagagaatggcactgcggggaggtcatgagctagtagatccactggacccagagaagattggaagtaatccctgccgtttaatccaaagaattgtagccaccaacattaatatgatttttgttcatatatttctgaaaatgggagggaacccacttgatgcaacggtcctgcaagtttccaggaggggttgagccacaccaaaaaaatagaacaataaaaataccagctaggggatatgaaagatcagtgaaataggatactcaaggactctgaaagttcggcatagaaaaggcagctccaatattccttccacatctttagaagatgaccttctccggtgttttactttgttaagagcagcaagcactaaagggcatttgatttctgaaggaacatttgaggaccatagggatctcgccagctcccatctgtacatggaagtagtagagaagtactcagatttgttttgtttgcaaatgagtttgtcgaggtcaaactttgggtgaaagccattattgacgagacagcgcaagataggcgagattactatgatgatcttcccaccccacaacccctccatccaacctcacgcccattccccttttctttttttcatgtgaacaggaggtagtaggaagctaccaccattttattctacgaataaagaatgcaaaatactctgtaacagagagtggcaacagaaattcagcttacaaacacattacaccccacgcccataatattttacaattaatgtaaaagtaataaaatttatgcaagcaacattaaagaaaggaataaaataatagccagtgtaaggtttcaatcatccttccttaggttgcatttggtgcatcaccggacaattttgaaaggttatttgaattatcttcaagatagattacaatcattaaattaccagtaatattgattactatgtttggtacatataaataaggttgcagtaaaattattaaaaattttgattgacatgtttggtgtgacaatcagattgccagtaatacggaatcaaatttttaaaatacctctttaatcttataataataataatatattatattatcatatataatgatatttatataattatcataatataatatattttaatatagtatattataatattatattatgatattataataaactattataatataatataatataatatattattttaatatttaatatactaatataatatattatactataatattatgtataataattatatattatatattatgttatattaacagatattattataatatattataatattcaaatattaatatattataccatattataatataataatataataatataataaatatattattatatagaataatatttatataacatatattacaatatattaatataatatataatattatataataatataataataaattattataatataatataataataatataatataatatattgttatatataataagatttatataatatatattatattatattatcatatactatattattgtaatataatatagttactataaaaatataataataatataataatagtatattatattataatatattatattatattattatatataataagggtaggatgagagctgccagagaagggggtggagggatggattttgtgtgatttttttttgaggaataattttatccaaaaattttttacaatattaccaaaaaagtgataatttggatagccacctctctccaaggctatctagattatctcttgagagataatctggattgccaagataatctagattgccaccacaaaagcataccaaacacaataatctggtggatccactttaaattgctagaattttggataatttatattgccacaaaaaaaatataccaaacacaataatctgatgggcttactttaaattaccagcaatctggatagattgccagctaccaaatgcaaccttagttcttacgttggaagaggttctaagttcggctaaaaggacagcactgcatttatgtttttgaaaagaatagtatttgatattgatcaaaggatggtagaaccatcaaaaattttgtatataaagaagaaattgttgagagttaatgtgttgggtttcctaagcacaatatctatttcctatgtaattaattagtgtgtattttataaagcatgtactatttcctatgagatgaattggggagaggaaaagttgaattaatgatgagagttcaagagatattctgtaatctctaaatagatgagacttgcagcatgaacgtatgtgtaaaaaaattatcaagaatgaaaaattaattcttcctctcatattctgtccatcagaaacatcgtagttcaattcttatttccatcatttggtatcagagcaagtagatcgtggaaaagtttctgcgaaaaaaaaaaaacaaacaagagaagctatggctaatccaagccaaaatctacagcaacacttcgttccgatcttcaccggtgacaattatgatttttgggctgttaaaatgaaaatagtcttcaaatcattaggcctttggagcattgtcgaacaagactaaaatgaggaagacctagcctcaagttcatcatcaactaatcaagttgatcaagccaaacaacttgaagagttgcagcaaaaagatgcagcagccctcttaaaaattcagcaaggagtctcagatacaatctttttaaggatcattcgagcaacaaaagcaaagcaagcttgagagatcttgcaaaatgaatatcaaggagatcaaaaaattcgagatgtcaaactccaatctcttcgaatggagtttgaaaatttgaagatgaacgagaaagagaaagagacattagaggaattctacaataagcttgttcagcttgttaatcaaatgaagagctatgatgatgacattcccaacaagagattaaatgagaagattttaatctctttaccctttaagttcgaatccaagattgccgtaattgaagacactaaagacatctccaccataaatgttgaagaattgaccggctcactgaagtccagtgagcaaaaattgaatcgacactataaaaaatctattgacagtgcttttcaatcaatgctcgatgttgattccagaagtatagaaaaaagacctcaagaatcatctagaggtggaaggtgtggtagaggaagaaaaagaaattcaagaggaagaggtagaggaagttatgatcgaaaaattgaaggtgacaactctcaaaagaagtttagaatttgtaataggagtagccatgaagagaaggattgttggttcaaggggaagccacaatgccacaactgtaagaagttcggccacttgaagaaggatcgtcgcttcaactccaaccagcaagcaaattacatcgaggaaaaagaagatgaaggcaacctattttttgcatgtcaaagtgtagcagaacaaaaaaatgatcaatgattcattgacagcagctgtagtcatcacatgacctcagatcctgtgtccgatggacaagcccgaggatggtaagaatccaatcagcaagtagaccgtcaaaaagatagatgatgtcctaaactctccagatcctactatcagtggtaagcaaatcacagatccatagatggtcatccacctttatgcttacatatgtcaaccatctgaaaagagagaagctagagatccaagcatcctagctcacctcaactgaagctccatctccaatcaactatctgacttggacaaatacagcaacagcacgggcacagatctccctccaaatgaaagagcatccacagacaattcagctctgggacccctgactccatgccccatatcaagcctttatcatcctattccacagataatcagactggagaagaaatctagcatcatgtctgataatcatagcctctctcttatcgagtagcgactaaatcttgggccccccatctcgcatgaactaacagaccacctctcaacaccagatggactccccggccattatgcttagagccccacaagaagttatggaaaagctcctgaggcaaaaatcaggcaccaccgtatttgccaagaggtagatcgagatggagcttaggacagatctaatgaggatcatcctacccatcatagagacgatattggcttgccagccatcgaggcgatcctggatccactgctccatatgcctgtagtcagccctccaaagatgttgtcccataatagaaaccccaagataaattaggattccagtctactcctggatctccagcctgtcctggatagcctgcatcatttggacctttgttttggagttgaaaatgattgtagacttccgcaagttcacaagctggcctaatgcctggcagtaggcctcaacgatggaagcaaaacatctttcattttggatggaggcccggccaattagaagataatcatcgacaaaaaggaggtgtgagagtggctcagtcctaggggcaggtttgtaaggctccaactctgatctctgggctatcgctctcagcattcgagacaaagcatcagcacataagataaacaaataaaaaaaaaagaagacaaccttggagaagcccgagcatcgagggaaagaaatctgttgatgcgttgttgatcataattgtaaaactcagagtctccatacaatccatgatccaatcgatcctcctgtcctagaagtcaagctcctgcatcgttcgtcacagaaaacaccatctcatccggttataggctcactctatgtctagcttgatcaccatcaggctatgacggatagaagtccatcgtaaattatgcatgaatttctaggcaaagaggcaattgttagtgatactgcgactattgacaaaggcatcctgctcagaatagatcaattgagatataatcggcttcagtcgttcgatcaggatcctggcacacatcttgtagaggatggtgtagaggttgattgatctgaaatgctctggggcaaatacatcagatcgcttcgggatgaagataaccaacatcttcttccactcttcctgtatgcctctggagtcgaaaaccctctgcgccacctccaccaccttacctccaactatggggcaataatgatggaagaaaaaggatggaaatccatctagcctcgaggtcttgtcctccttcagggatcagagagcaccccgcacctcctcagtggatgctgtgcgagtcaaggcctctttctcctgactgaagacatcactcacatgctgggcaccccgaagtggagaatccctgccaagtgccatcgtccagtgaaatctaaagaattggatgatcagccctttaatgtccccactgtcctccaccattgcgccatcgctttctctcagttgtctgatctggttggcagacctttgaattatcatcgactaatggaagaatctagtgttgcggtcatcctccttgatctactggatcttaaatttctgtctccacatcgtctcttactgtctcagcaaagaatggtgcatcgagagcttgcgatgaagctccctcaaattagactcctaaagcctcccatcctgatcctctctcatctgtaggtctgcaatgtttgcctccatctcttcgatctgtctagtacgatcatcgaccttaagatgattccatcagatgagcctatgtctagttaactccaacctccaagtcactcgatatatatcttgcatctccacagaccgacaaccttcatacctcattgatcagctcccatgacctagagtagaaggtccagaacctctgaaatctaaaaagagccctaggcatacatgggccatttatggtgaccaaaagcggacaatggtcgagggcaatcctcggtaaatgctgaacctgatgcccaaaaaatcactggaaccagtcggcgatatcaagggcacaatgaatcctctcctagactctggccgccccctgatggttgttgcactaggtaaatctgggttgagagcaacttaggtcagtcaatcaggctctcatcatcaataaattgcctgaattctttggaatcaatgctgtccacatgctatctgccgtccatcttctcgtgaggttccacgatgcaattgaagtccctagcgataagggatggcaagccttccaacaccatcctgaaaatcttggatcagagcatcctccgctccttatactcagtactcacatatacgctagatagtagccacgagccttcaatctgctctaacataattaaggccatctattgttttcatctatggaaagcatccatcctaatcaagctatatctccacatcatcaagatctctcttgacaggcccctaatggttctttgaaaatgattagtgatgtttttctcattatattttgataaatttaatgctatatagatagctcaacttggaaacacttgagccatacaaatcaaatgaagcttttaataaaatcatcattgtagctagcatggtagcgaataggctgctattatgattgtctaaaatagaaatagcatgtaattggttcttaatttaaactataaatctagggttacctcagtggttataccctccacttaaaaactagaggtttcggatttcttgaacgggtacatcctcaaaatttaatcatgtaattatatatgacaagatttcatcctattcaaggaaaataaaagatcaacttaaactttgttatttttttatttcttacattggtcatttgtatgctataatgataaaataataataaaaattgcaataaaatacctcaaaattttcattttcaatgaaagtgatcttatttgttgatgaaaaaattgtaatacaatctatattaccattgttattgttattattgtaactattattattattattattattattattattattattattattattattatctttgtattttgtcccatcatattttctcatccactaacgttttgatcgacttttgtcctaaggttcatgagataaaaatggttttataataatatttttcactagaactaaagttatattgtatttgcaaatcattgatgttccatatgccatgtgacaagtggggcttagatcggtgtcctgtagtggatttgttgcatgaggtgtagatggtaccttggtagcctcacttctaactacagtaatttgcttcccataacaatttttttgcagttgtattggtctacttataaatcaaaaaatagctattattaatcttaattggaaaaccaaatgcttgcaagtctatgatgaacttgaaacatgttagtgatttttaaagatgtgcagaattaacaatgaattttggacacattctaattaatttttttaattttatcgataaaagactattgatagttttggatggtgcatcttgaagtatttagacatggattcgtttgcacggaggccaccggaccgcaaggaacattaaaaaaaaaaaaaggtttacattgtgctcctacttcagttgtccaaacgtacatcgaataccatagctgtcatcgtgatgcaacttgaaaacacgcaatagtggcatcatggagaccgatggcatcaacttggactgactctttgggtcacaaacctgccatgagatgaaacattttcttatgcgcgtcttactgctagatactcccaataccattgaatttgattaatccacctcccttcatgctacaggataagaaatatttttcatcacattgttcctgtacttggtcaatcgccctgacaaaaactaaaactcatcaagctttgatatcgatccccacctccatccccacctcgcaatacggttttactttcggacggattatgagggaccaagtgggtggttcacgcgaaggagaagctactaacgttgcaccgagtggaaccacaagaccaattttgactccagacttgggcgaataaataacactgtatttgagtgcttatataatagagcatcatcgacaccatgaaataacacccgttcaccgagtatctagcaactcgacattgcagtgaataagctaaagttttggtctccatgggaaatttgcgtgcccaagtccaacgtccagatgctcgcaaaggagcatggagtgaagagagggaccggttttgtttttttttttttgaggaagtgcattgagaaatatggggaagggaagtggcgccatgttccacaaatggcaggtaagcgattccttataggaagcggagtcctttgtcattcttgaactcattgtgcttttgtggatttgaaggcctcagaaggtgccgaaagagctgccgactgcgttggttgaaccatctctgccctaggatcgacagggaggaagaaaaccgatcttattattaggcttcataagctcttgggcaacagggaacaacaaactatgaagattaattgccttggttagaatattaatattcttgtactttaattactttttctggtatatcaagttccaaacaagtaggataataaataacatgaatcctaatttagatttaagtgcaagaactattttttaccgaatgatttactgtacttcttttgcagaaacatgtacgccatcttttgaaaatggaatctatgcacttgaacctatacagaggaagttgccttgtgggtccaaagaaaataagtaataatatcaacgcatcttttttcgtacaattgtatctttgatttgtttgagatcattccacttcctcgaactgaaatgggggtatgcaaccgctaggctctggctctatttgctattttagagatgttcatgcaccgtatgtgctttcttgagcctcttgtcctgcaagggatcttctcaattaaattgtcacagctgaacacaaacaattcaactaatgagatctgaatttgatcgatcaggtggttattaattgcaggtaggcttccaggcagtacagcggttgacatcaagaatttctagtattctctcgcttgagaagaaaagtggaacttgaaaacaagaaggcaaagccaagtgctgaagccaaagtaatcaagccacggccatggggagcaccgtggcagtggatttggttaggagatcagcaatcatgtggaagccagcatcagaccgcttcctatgaggaatcgcttacctcccctctggggaacatggcgccaattcccttcgccatatttctcaatgcacttcctcagacgcctgtcctcctcttcactccatgcccctctgcgaacacctggacgttggactggggaatgcaaattacccattgagcccaaaactttagctcatgattcactgcaatttccagttgcaagatacttggtgatatgtgttatttcacggtcacgatcatgctttataagcgctcaaatattgcgaatttattcgccaaagactggagacatttgtggttccacttggtgctggagaagtagcttctcctttgcatgaagcacccaccggtccatcataagcggtgtaatacccggcccatttgggctctggactaagtccaaaccatcaaagcccatatatatatatatatatatataaaagagaacgagaagaagactnnnnnnnnnnnnnnnnnnnncaaaccatcaaagcccatatatatatatatatatatataaaaagagaacgagaagaagactcctatcgggagtcttcttcttcgatgaatcccgaatggaatagaagtcctaggaccaccggggtcctagagctctctataaataagtctcccttttcctttaagactctccaccggcgatcttcatgcttgatctctcttcttttctccgttgaagccgcggccttctattattgtgttcgttaaaaatcgaaagtcggagacgccatcggagctcaggtaagactccgacctttcttcctctccctctttcctttctcctcatggccttagatcatcgttggccatcaggatcgtcaaaaaattcatgaaaaggtgaggccctattttgctctgtttggccgaaccattttcctcttttttctagccaccggtgctgtcgtttgcggcatctcacccttaggtttggatctccacctctctaccaatcttctccgaaggtcatgaccgtcggtgatcggccaatgactgaaaaaatttcggaaaaggggccgatctcttatttttccgttcttttcttgatttctcgtcggccgaaaattaccgccgacaactttttaccccattgccatcggccgccactgtcggacaatcagccataccgccacgcctcgctagagcacaagccacccccttccccctcgtgtccctcctctgttcggtcaggaaaagagagagagaagagaaaagaaagaagaaaagaagagaagaaaaagaaaagaaaaagaaaaaaaaaagaaaaaaaaaaagaaaaataaaataaaataaaataaaaggggaagaaaatgagagagagttctctctctttcctctctcctctctcctctctctatcttctttctccactttctctctctattttctctctctaaattttttttctaaagtctttctattctctttctaattgtatcacggatcttaggataaatttcaaataaattaagatgatctgaaatcacttcaaaattcatgcagcaagttagatctcagttcgatctttattcaaaatttgtaacatcgatcatggttcatccatattgagttaccctgatatgacctctgataatcttaattatgattgcttcatatgaaggatataaagattttctctccattttctttttttacttttttttctagaattttctttctctctttatgaattttctctctccagaagtcttgtggaccagtggagggtccagatacttagacaaatctcaattttggttaatcctaggagacgtcctggatttatattattaggatcatttatccgtaatttctctatatatgatttttatgtttaactctgattatgtagagatgtaattgttgtacaagaagatattgagcaaaatatcttgattttggatatgtagattgaggagctcatcaatttctgtatttagatcagtcatcgataaagtaagaatctctgtacattatcatcattatatatgctattttatcattgatattgtattgttgattttgcatcattgaattcatgatcgatgaatttactatgcttgagatactgttatttgcttatatgatttttaagcataagtaaaggttatatcaatatatatgtattcgtgattgatggtatgattatatgagcatgatatatctattttgatcacactgtaaatcgaaattgatttgatgaaatcaacatataataattaaataaaaaagatatgatttggactagtcttgttatgtgggatagccggtcaggagcttatacctggaacaacccgtcaggagcttatgcctgggatagcctgccaggagcttatgtctgagacagccggtcaggagcttatgccttaggagcttgaggttgtaatgaatacttttgatcttgcatattctttaggacttactctaaggagtgtgcgaccatcacgtatctgactcgaatgttgggttcggggcgtgacagagtgatatcagagcttaggttatgatcatttggagactatgacacaagtgattaggatatgatagaatagtatcagagcttagatttaagatcactagagattataaagtgatatcaaaactttatgtatgatcaataggatgtgaaagagtgatatcagagaatatgacttaagtggtatcaaaactttaaggccactagggactgtggcataagtgatatcaaaactctgaaattataatcaatagagtatgatagataatattagagcttaaagttataatcattaaggatgtaatagaatgatattagagtttaggttatgatcactaaagaatatgacttaagtggtatttaagtttaaggttataattattcaggattgtgactttagtgatatttaaacttagattatgatcataaggaatatgatagacataaaaaaaagattcaatatttggatttcgaatcaatagatattatgatgaaatttatgcataagtgatatatgatatttataatagaattgatgagttatatcttggatttcaattagtaagattgatctaagtataagaagtattgatcctgaaatgaaaagaaagatattgatatgttgtgttgagtatactcgatgatttttgaatgctaaatttatatggtggaagatcatgataacttttttgattttgatgttaattatttgagcattataaattttagacttatcagaaggaagttaattaggatgtggtctaaaaaaaattacatcatacgagagagaaatattttgagtattgaatctataagaggttatatatgaaactcgaaattagattaaaaataataataataatagtaatatatacttaaattttattaggagaatctgagatacacatcttgataaaatctttggttattcaaaatatcatatttggatatgttttcttgatctttcaagttacattgaattttaagtccaaagtttgattttctaagtggatctgggatattttgatattattattaaattaaatatgaaaaaaattaattttattagaatatgatatacatgttatgaaagaatttttaataattcatattaccatctttagattggattttttaattttgtttatgattgttgaagatagtagagtatattaattattcaaatcaaagtttagattttcgaactgatctaagatatcttactagtattaaattttgaatgacttatataaatcttaacacataagggataagattttatctgaatatattgattaatattaagggttgtgatgaagaaagttttacaagaaataatcaagttgattttacttacaaaaatgttgacttgagttcttctagtttgttcaagttggagttaattcttttgcaaagaaaggttggtttagaagtagtctcaataattgtaaggtaaatctaaggttaactccaattaattctaaatatgttggatctttgaggagtgatgaagcttatgcaatgaattcaaatatataaagtggatcaagatttaattctgatgtgctatgtccaaagaatagtaaagacacagaaacttaaagttttactctaagttttatatgaaatttgaaggttagatctatctttgattgatctaacatacaaagatatcttttgataaattcatataatttgataaattaagatcagagtgcgcagcaaaagcatgatggtttaaattgattagaaatattaatcttttaaatcaaaagatattatggaatacattagttgcaaataaagaaggattttattgatagtggatgaatgctattgatattttcgatctaatttgatcacagatatgcaatttttgtcaaaaggtcatttcattgcagataatgctaagaaactctagatatcttaaatttactattaatagcttgatagatcttttgttagttcaaacctaaaatatcttgacatagatcttattttttgaaatttaatattgttacttgaactaacatagaaggttgaggttttttttgagatgaaagtctacatgtaaaatttgttggagggtcaaaaaaagaaaaaatcgatgaattttgagtggaatgtattggacaaataactatggtatgttaatacaagtccaaagtgttactattcttcaaaaaaattgagaaatcaataacaagggatgagtttgagatttcaaataatttttgttataacaagattatgagaaataaataatatataagacattatcagtagcatgagaatgacatgatgcatgtatatttttaagaatatatctcaaacaacataatttaattttgaggacgaaattatatgaagatgggagaatataatacccgggccatttgggccctgaaccaagcccaaaccatcaaagcccatatatatattaaaaaaaagagaatgggaagaagactcccaataggagtcttcttctctgatgaatcccgaacgaaatggaagtcctaggaccatcgaggccctagggctctctataaataagtctctcccctcccttaagactctacaccgacaatcttcgagcttgatctctcctcttttctccgttgaagctacgacctcccattattatgttcgtcagaaattggaggtcggagacaccactggagctcaggttaggctccgacctctcttcctctccctcttttctttctccccatggccttagaccctcgtcagccgttaggatcgtcgaaaaatctatgaaaaggtgaggccctattttgctctgtctggccgaaccattttcctctttttttcgatcaccggcaccatcgtttgcggtgtctcacccttaggtttagatctccacctctctacctatcttcttcgaaggtcatggccgtcggtgatcggccaatgactgaagaaattcaggaaaaggggccggtctcctgtttttttgatcttttctggatttctcaccggccgaacattgctgctgaccacttcttaccccattgccgtcagtcgtcactgtcagactttcagtcgtaccgccatacctcatcggagcacaagccaccccctttccccctccgtgtccctcctcaattcggctaggaaaagagagagagaagagaaaagaaagaagaaaagaagaagaaaagaaaaagaaaagaaaagaaaaagaaggaaaagaaagaaaaaagaaaaaaagaaaggaaatgaaagagagttcactctctttcctctctcctctctctaccttttttctccactctctctagattctctctctattttttctctctaaaattttttctctctaagatttttttattctctctctttctctctctaattgcattacggatcctaagataaatttgagatgaaaataagatgatcttaaatcacttcaaaattcatgcagtaggttaaatttcagtccgttctttattcgaaatttataacatcaatcatggtttatccatattgagtcatcctgatataacctctgatgatcttcatcatgattgcctcatctgaaggatacgaagattctttctctactttctctttctactttttctctttagaattttttctctctaaaattttctctctctttatgaattttttctctccataagtcttgtggactagtggagggtccagatacttagacaaatcccaattttggttaattctagaagagatcctagatttatgttattaagatcgtttatccgtaattttttcatatatgattttttatgtttaactctgattatttagagatgtaattattgtacaagatatggagcaaaatatcttgatttcggatacgtagattgaagagctcatcaatttctgtatttagatcagtcatttataaagataagatctctgtacatgatcaccattatatatgctattttattgttggtattgtatcattgattttgcatcattgaattcgtgattgatgaatttgctatgcttgaaatactattatttgcttatataatttttaagcatgagtatgggttatgtcaatatatatgtattcatgattgatggcatgattatatgagcatgatatatctattttgatcacactgtaaattgaaattgatttgataaaatcaacatataacaattcaatgaaaaagatatggtttggactagcctcattatgtgggacagtcggtcaggagtttatgcctggaacagtccgtcaggagcttatgcctgagacagctagccaggagcttatgcctgggacagccggtcaggagcttatgtcctatgggcttatatatggatcagccggtcaagagcttatgcttgggatagtccgtcaggagcttatgcctgggacagctccatgggcttatatacagccggtcagaagcttatgcctaggacagcccatcaggagcttatgtctgagacatcccatgggcttatatatagatcagccggtcaggagcttatgcccagaacagtccgccggagcttatgtttgggacaattttgaaaggcttatgagtaaaaatttgatcggatggagattgaggtatagtcttggttagtccaaagccagaaagaaaaaggttaaagatcatgtgattatgaaacaaagaagtaaaggataagatatgaaacaaatattgaataaaaatatttcaccgttaacatttgatgatacatctcttttgacaagacagataatttatgaatgtttgcagtattctggacattgaacataaaattttatgctttattgtttatctttatttttagattatattattatattgatgtgatatgtgggattcttactgagctgtaaagctcacactttctatttctctttttcttttcagagttacagatgctcataattggttatggtttagatttacggatgagcagatgaatagatagagtgtcacgatatctgatcagaggattgaaggaatttaatttataattatgtaagttttattaattattattagaattagatattatgaatgttgaggttgtaatgaattacttttgatcttgcatattctttaggatttgctctaaagaatatgcggccattacgtatctgatttggatgttgggttgagaatgtgataaatgggctcaaagtaaaatagtgaggatgaagatgggagatatccaagcttgatgaattatagttcttgtcggggcgatgatggaccacgttggaacaatttaaaaggtgtgcgtttcatctccgatgggttcatccattgaattcggtgtgctgtggggcgcgtcttgtcgtaagacaagaacataagaacatgtttgctcttatggcaggtttgtgacccaaaattcaagtccaagttgataccgtcaggcacggtgattctactgatggccgttttcaagttgcctcacgatgacagctatgggatttgatgtttggacgactgaagcaggaccacagtatggttttgatcactgtgcatcttcgaaggagtgtgtcggttctgcgatggcagtgccagtgcatgtaaccccctttttttttttttttttaatgcttggtccagtatggtgcaaataaatccgtgtctaaatatttcaaaaatataccatccaagtctcagatcgagaatctcttatccctaaaatttgaaaatttagaataaatctcaaattcattgttagcactgcaaatccttagatatcaccaacatgtttcgagtgcatcatggacttagcagcattcgattgtttaataaacgttattaataactatattttgatctacaagtagaattatacaactttaaaaaattcattgcaagaagaaaattgctctgaggtttggagtgacgctgccgtagtaccatttacatcttctggaacagacctaccttaaggcaccaatctctaggtcccacttgtcacatggcatatgggacattattattttgtcgatgaccttgcaaatacaacataattacttctaagagaaaatacaaattataaaaccctttttatctcacgaacccgagaacaattgaaaacgaaaatgaaaaattagaaacattttcattccatcacttccatttttactgaaaataaaaaattaaaatttttttaaataatttattagaataaatccatcgatcttcgactcagatcaactgactactgactttgactcaacaacagctgaccaaccagacatacaactccgactctacatcgactgaatatgcggttccgactcttcatcgaccaactgagcaaactgcaccgacttattaccggctgaccgactaatgatttgactactatcgatcgacagcagacgacttagacaatcggtataacagaactactaaccgacgatcgtttatagattctaccgacatatggtcggttctaccgacatatggtcggctaatctgctcaacataccataaccgtcatgaacggttatcgactgcatatcacggtgcgatcagtggaattaacgatccactacgtgattatagcccgatgatttagcgtcataaaatacgggaccacatccgacggttacgaaaacctcatctataaaagggggtaaagaaaacaggactggtaagtcaattctgggccaaacctctactactgtttacattcaactcctgttcatcaacttttctctctgacttatgcatcggagggtccccaccggacataaattcggtctgtgtggatgcagttttgcaggtgttcatttctggcgacaggcgacggagagttggtcgtaacagtttggcgcaccaagtaggagagaagataacttgcaatgacgaaaatcagggctcaacagtcaacagcaatcggatcgatgaggcactcttcccgtcgagaagaggctcctcccctccctccggtagcagaacccaattctctgcgacccgtggtcaccacggacgtccagattgctgcaatcgtacaacaaatgaatgttcttacggaggcggtcagaagcctccagcaacagtagacccagccaccacagccaccggcagagcaaccggtggcgcattcggtgccatctaggcacaatcgccgtcatccacggcagtctccttcaccagagcggccgtctcggccctctcatcaagacgagcagcggcactcgtggtgctctcaatgcgccacccatcattcacgacgtccctctccttttcagttagatcgagcaaggaaaggaaagcaatcgcgaacaccgtttgcttctccatctaactcatcgggagattcaatcttcaaagttttccaacggtgattcgatgattatgaacataaattccaggagatcaatcgccaacttgctcagcttcaagtggaaggtcggaagtcctccaatgactacaacttccacactgcccagccattttctcgatacatcttggactaaccgatcctatttcagttcaagatgccttaggtggaaccatacgatggatccaccaatccgatcgaccatcttgagagctacaaggctctcatgacgattcaggggatgatcgacgtcctcctatacatcgattttccgacaactttttggaaagctactcgagcttggtactctgggcttcagtcaggaagcatatattctttcggatagctagaatattctttcatggctcacttcagcaccagtcgaaggccgtcatgaacttctgatagtctcttctcgattaagcaaggagagattgaaacacttcgagatttcgtggctcgttttaatgcgaccacgcttgaggtcaaagaccttaatgaaaatttggctatctcgtccataaaaagaggtctgaaaaaatctcgattcacatattctttggataaaactctctctcagacttatgccaaacttctggagcgtgcatacaaatatatgcgcacagacgaaggagcttctgactgacgccagatagaaagcaaaagtcagaagaaaaagaaacagaaaaagggaggagctccagccgaatcaagtcggccaccgtccaataagcaagcttcaccttgatgacggagtccaaggtcgggtaacggcaggtatgactcctacactcttcttttcgctcttcgtgcatagatccttatggatatcaaaggagcggaatatctacgataccccccaccgatgaaagcattgccgaggagccacgatcgaaagaagtattgttagttccatcatgatcacggcaatgataccaaacaatacatccagctcagggatgagatagaagccctgattcgacgaggctaccttaaaaaatatcggagagatccgccgactcaacctcctgctgatcgacgatctcaactgtaaattgaagaagctataaataatcaaccgactgcaggagtgatcaacatgatctctggatgactggataggggggcaactttcgaagatgagtcggcaaagcaacgatgactcgacaatgtaataactttttcagaagaagatattcggagaattcaaactccccataatgatgctgttgttgttttgacaacaatagcgaactatgatgtaaaaagaatcattgtagataatgaaagttcaatcaatattttattttattcaactttctcccaaatgtgactgtcgactgaccgactcagaagagtttcgatgctactgatcggcttcacatgagatgctgtcacagtggagggagaaatttttctccttaaccgctgggaccgaaccacaacagagcactgttttcataatgttcatagtgattcgagtaccttcggcttataatgccatactcggatgacctgggcttaatgctctaagagtagtgatttcgacataccatttattagtctgatttttgataagatatggagtcggagagatgcgtggagatcaacaactcgtccgacgttgcttttttgtctccatccaaaataataaatctgaagactctttatctgttgacaaattggatcaaaggggaaaatcaagagaggggtgaaccagctaaacaacatatttccatcccgttaaaagaagaagatcctgaaaagacgatccgaattggatcacaattatccgacttagagcggcaataactaataaaattgctcaaagccaacgccgatatttttgattggtcggccaccgacatgcccaggattccttcagaaataataacttatcgatttaacattaacccaaacgttaagccggtgagatagaagaagcgatcttttgctcctgaaagacaaaaggtcattgatgaagtagtcgacaaatttctcgcagcaggctttatcaaagaagctacgtatcccgactggcttgccaatatagtaacactaagaaaagccaatggaaagtggaggatccgcatcgactatactgatctgaatgtagcttgtccgaaggacagcttcttgttgccaaagattgaccaattggttgatgcgacttctggccaccgacttttgaattttatggatgcctttgctggatataatcaaattcgcatggcaccagaagatgaagagcacacgatttttgtgactgacaaaggcatatactgctacaaagtaatacctttcggtctgaaaaatactggcactacctatcaacggctcgtcaacaagattttcaagacacagatcgaatggaacattgaagtatatgtggatgacatgctggtgaagagcctccaaactttagatcatgttcgggacctagaggaagctttcgacacactccgacggcatcagatgaaattaaacccgactaagtatgcatttggcgtaaccactgagaaatttttcagatttcttatttcacaatgaggaatcgaggttaatctcaaaaaaattaaagccattatcaacatgaagcatcccagttcaaaaaaagagatacagcaactcaacggaagaattaccatgctcagtcgatttatttctaagtcagtcaagagatgcttgtcattcttcaaaactttatgatagatgaaagatttctcatggtcagatgaatgccgataatctttcaaagacttgaaataatacttggcttctccacctttgctcagaaaatcaaaggtcggggagacattgtatctctacttggcaacttcagcagaagcgattagttcggtgttcgtccaggagggtgagaatcgaatccatcgacctatctactacaccagcaaagcacttcacaatgccgaagtctgatacttaaaaatggagaaaatgatctacgtcctaatcatatcggcacaacgacttcgtccatacttccaagcccatccaattgtagttctgatagatcaactgccgaaggcaatcttacatcgacctgacacgtcaggtcgaatggcaaagtggacagtgaagcttgacaagttcgacattcaatattgcccacgaccgtccatgaaggcataagtcctagccgattttatcgttgaatgaactatatttaacaataagccagaagatacagatgacaacaaaataaaagaagctacgactcccaaacccaacttaaagtcaacctgggtgctgcatattgatggagcatctaatgcacaagatagcggagctggcctcatactcccgaattccgaaggggtagtcaccgagtacgtcattcgattcaactttaaagcctcaaatagtcaagttgaatatcaagcacttttggtcggcttgagaaagagcttgagatttacagtttgaaggatttcaccgactcacaactgatcactggataggtcaaggataaatttgaggcccgcgacctcgttatgatgaagtaccttcagaaggtgaaagattttacgacaagcttaaaatattttgagatttttcatattctcataatcgaaaatattcgagctgacgtactttcatgactggctactaccgttttcaacttactgggtcggatatttgttgaatatctcgaacattcgagtattgataaagtcgaggaggtattgtagctcactatcgaaccaagcggatggatccgatcattcaatacctgaccaacgggacccttcctgcagactccttaaaggctaaacggctctaatggatggcctctcaatatgtaataatgaatagttatctttacaaaagatctttctctctccccttgctgaagtgtttaggacctacagatgccgactatactcttagagaggtgcacgaaaggatttgcgaaaataacttaggaggcaagtctctagtttataaagttcttcgacaaggatattattggcccaccatgaaaaaaatcgcagttgaacctgttcgaaggtgtgaatcatgtcaaaaatatgtaaatatacaacatcaaccggctagtcagttgacgttgattatagcaccatggcccttcgtgcaatgggagattgacatacttgatccttttaccctgacatctggacagagaaaattcatagtgatcgccatcgactactttaccacatggatagaagctgaacttctgtcacaaatcactaaaagtaagatggaagagtttattcagaaattcatcatttacagatttggtttgtcacataccatcatcaccgacaatgatcgataatttgacaaccaaaattttaaaaattttgtgcgaagtttcatattacgcacaaactcataacggtcggccatccacagtcaatggtgaggtggaagtaaccaaccagataatcctacacgggctaaaaactgactgaatgaagccaagggcctctagatagaaaaattatattcgatcttatgagcgtatcgaatgactccccgcataccaactggagaatcctccttcaacttagcttatgggacaaaagcaatgataccgcttgagatcggattgccgttaacaagagtggagcaatatagtgagccgagcaactttgaatatcggagagccgacttagatctccttccagaactctgacagcaagcttaagttcggatggctgcatatcggcaaaggatagcccaatattacaacgcaaaagtaaagccgaaggtctttcgattaggagatttggtcttaaaaaaaataaaaatctcaaaacctctggatcaagaaaaattatctccgaactgggaaggaccttacaaaatatccaaaactcttagaccggacacatatcggctagaaactctcgaaggatcagcgattctccaaacatgaaatgccgacaatctgaaaatgtattatcaataaaattgtcgaatgtacattatgtaaaatacaaacagaattttagaatcgtaagcctttgacaagttttatcaactactgactatatgtcggcttctattgccaaagtcgaactatctactgtactttgacacgaagtttatctcagcctccactataaaaatcgaagaatcaactgcttcggtgatgactgtatttcggttctcatataaaaactgacataccgactataatctcaaccgatatcgactacacaggctttcaccgcaaaaattgaatcgtcgataatatctcgattttcaatgtcgtattgtcactgtagaagctgactacagtcgaaagactaatatgctgatttagtcctaactaagtgaaataaaataccaaaacgaccaaggttggattgaaattacaccgactaggctacagccagttgaggggtattcggcttaccaccgattatcaaataattcgacgtacaagcctgaccaaatatcgggcataggatatttgacctataatcgttatcctaatttctattaattacatcaaaatgattacacgactgatggatattctacaagtcttaccgaatgattggatcactgattaatattcggtggctactgtacattaaacattgcagacaatattccagacgaaccaagttcaaacttagaagaaaaatattttcgttcattgtcaaaacaagaagttacaaaattagatcgaagtctgattataggtatctgattacaaaaagaaaagcaaaatacaccgactaagcttcatcatcattcctttgctcgggtatagcatcctcgacttgaacgatttcggactcaatcgatgcttcttcttgagttggagcgccttcttctttagcaactccatcttctgatcttggaaggatgatgctgctcaatttgaggtccggatatagttttttgatcgcatctcggccgtcttcatactcgacgtagtacgaagcgaagccattttcgaggatctcttccctgcattctttcgaacctcgaaaatcctcaactgcctgacccagtgcttctcttgctgactctactttcgccttggccaaatcagtatcagctcgagcagaggataattcttcttcggccagtgccaatcttttcaggctggcccaatgacgtccatgttcggcttcgagttcttcgatgtatctgtctcactctcgtcaaagccggtggatagaatgcttcttgctcttgacctgtgactcaagagccaaaatagccccgtgaaccgacttaagttccgcccctgagaatgccaagtcgtcagttagtcaagaaacctcctcctaaagtttggcttcccgctccgctgctgatttgagttgttcaagtgcagtcactttctcagcatcagtggctgtcaccttattcttccatgcactacggaagtcggcaaacttcgtgtagccgacctccaggtcaaacatgtcgtggatcaactgcagacagagaatagattggattatttaaaaaaaaaagatgaagttgatctgaaagttgggagcgataatattgggcattggggcaacaatccgacagagttccagcaccaaaaataatgaaaagtaaaaatttggctgatagtaaccctatatataggatccctcaatgatcaagatgaagacggtcaaatcgaaaatttaccagatgatgacacgtggcaacatctgtatcattaatcaggcggttcgatgcacctgcctcagattgagccacatcacctctatccgcatgaataatccaacccaataacattcggacacatggaacaaatctacttgccagaatcatatcatcagacgtcgaatcgactttctgaaacgacgcctgacactgacaactgatatcgaatcatccgatcagtgtgacagatgactgtacctgtcaatatgataaaatagtcgatcatccatatctcgaagaaaacggcatcaaaatcaaaatttgatgtgataaaaaataacttccttcgtccaacgtgacaaactcgggataatatacactcgactcactttggacttgggagtgggagataactgttgggataagtcaatcgacctccgactcaggtcaattgactaccgacttcgactcaacaatagccgaccgaccggacatacaactctgacctacatcggctgaatatgcggttccgactcttcatcgaccaactgagcaaaccgcaccgacctattgccggctgaccgattaataatttgactactaccgatcaatagcagacgacttaaaccatcggcataactgaactactagctgacggtcgctcatggattctaccgacatatagtcggttctaccaacatatggtcggctaaccatcgcgaacagttaccggccgcatatcacggtgtgatcagtgaaaattatcgatctactacgtgattgtggtccgatgatttagtgccataaaatatgggaccacgtccgatggttacgaaaatctcatctataaaaggggagtaagggaaacagggctggtaagcctattctgggccaaatctctgctactgtttacattcaactcctgttcaccaacgtttttctctgatttagacatcgggagatctccaccgaacacaaatccgatctgcgtggatgctattttgcaagtgtccattcctgacgacagatgataggaagttggccgcaacacaattattatccattatcttaagattatagtacataaacaagtaatataacaaaaaaaaatgataaaagcttcgattgaatctttatttacatataataaaatgaaatcttgttatataagtatatggttaaattagggtgtacatcattcgagaaatccaaagccttcgattttttagtggaggatatgatcattaaggtaacccgtaattcatagtttaaattaaagcaaccaacatggctagttcgatacccttttttatttaatctctatctcatgttaagattttaatcaatttaattaaattataccatcaaaatatgatcatatcataatgtatgcagctcaaaatgcacttaagatagttcatataaaacattcttataattttagctaacgaggagaagatctaagtggaattcttgtctgagcatgcaataaattgacaactccaatagaatgcctgataattcttacccgagatggcaaattaaagccagcccggccagcacagtccatttataagcgggaacatgtgatgccactcaaagtaggatacaaaactttttcaccgttcacgattcggccacttctgtggcatctctatcaattcagcgagcgtacttctgatgttgatgcttgtgcaatccctaagacatgatttccacttgaaaagtattttaccaagttttctgtcttcagaaatatttgatgcattcacttagggtcttcgattaggtccagtatgtgcaatggaaaatagaccttaaactaggatggagctattgagaatagtatcccaaagttaatcatcagcctgttgtgctccttttgtattagtacatgaattataaataaataaaagttattttgatatttttttcatcataaatgtttcatcttttaatgaactcctgtattgtggtaaagtccttaggactatttagactcgacaaagaaggatttgtcgcttagtccttaaacctgttcgcgaccaaatgatacgttgttacctaggacgacaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatccaagggagagtaatctgttggagttgtttgaaagcaatttatcaacgtgctaggccacaccttacaagcatgtccatattgctgcaacaatctcatcttaaataactatatacttagtttagtccttgcttcaaaaaaaacaaacaagaaaaatgtatggaccaggaggatccttagactcgatatagactatttttgccactatgagtaggattaaatagagtctacgagtaagatctacagtatcaaaaaatcaaattgtgtgtcaaaatttaggagatgataacattggtcacacaatagtcaattaagatgatattttttaaattagataatttttttgagtttacaactttcgattagcctccaaaaaagttaaatcagatcaaaattctatcatttggatctcaaaacagactggtcaaacgaaaactttttttttcatgatagattttgactatagattatatttcaactgtaaaaaaactagactggatgatagaaggtaaagttaatgtacaagtctgatcttcctcttgtaggattttagcattttttcataatttttatattgatcatagtttttaaagatttagtcctatttaaattaggaagaggaatgtaacaaaattgtttaaggatggacgtccttctaaaaataaaaaagttcttttagaaattaggaatagaaatcatatttaaattatgcaagaaaaaaatctcattattataaatagggtttatgtatatcaaattttatgatggagaatcaatcaacgaaagagaagaagatttaagccctagtttcataattttttttatcttcttctattttctttctaagatattcaagttgagcgaattaaaaaaaaaaaaattctctccaatcagattagattaatatcagagtattagtcctttatatttatagggggctttagtgcatggcccagacacgcaagcaatacaataactagaagaaaggctatccagttttaagaacatcaaagaataaagatgagtataggtgctagttttttctcgatggataataagatgaagaaacatcttagatacaactagaggaaaaagattttctaactcatcaagatcgtctctagattgatgatatattcaatgcaagcataagcaccagtaactgatattgtgaagttatcttcgatatttagagatgaagatcctccatctaatgaggatgagcaatctagaggtacgaaaaatgactcttttcaaccatttaaagttgaagctcgagtcgagacctctgtatataatagaaccattgatgtgaaaagactagataattagctagactagttagaaatctgctttaatatatatgaatacaatagtatctaaacggtggcttttgatcgtttcaaactttctagccatgctcttatatagtggaatttatacatgagaaacaacaacatttctaacttgatatagagcaaattcaatggcctaatcaagaagcagttttatctaattggtcatgaggaggatcaatagatcaagtggcaatacttgtggcagaagtataatcaatccaaccaaggctacaccaccaagttttataagcaagcaatcttctttgaagtctttattcatgatcatgcaatttttataaagtacattgaaggtctctataggagcatctaaaaggagctgaagctcttccaagttaaaaatatcagtaaagttaatgtaaaggccatcaggattgagaagaagaattaatctaagaaaagcaataaaggtgacaaattcaaaaaggacagtaaaagattaagccaaaagagggaccagggcaagaagcagaccaacatgactcaaaaaaaattttgtgatcactacaatagttcgggacacatcaagaagaagtgtttaaaacttcaccctaagttgcatcccaagaggaggaaggcaaaagatgatgattccaaggagaaaggaatggcggtcatcaatgctatgaaggtttagaagctacccaagcttgagtaaacaaacttcaaattgagcttgatgacgaagaaactcgaaacagcaattgaggtagatttggagatgtgaaaaacatagttagtaggtcaagttatattcagtcagtaagctattttagatcctggaagtcaaaagaaccttaactttgaaaatttagtttagaagttagggttgcagaccaaactttgtacctattgtcccagcaaaatgacttgttaatgtctgtagcaaatttatgatgatggtatgagaaatcaatactactcacatgagatgtcatgttctcaccccttagttctacaaactgactaatcaagattgagatagaccaaactttgtacctattgtcccagcaaaatgacttgttaatatatgtagcaaatttatgatgatggtatgagaaatcaatactactcacatgagatgtcatgttttcaccccttagttctacaaactgactaatcaagattgagatagatgaggagtcaccgtagtcatcatcgacgaagaaggtaagagtatccatactaggaagtctagatatagaagcgcatcaggttgttcattgagatccaagagtaaaaaagagccaaactacaaaccatcttcgagcaaagctaaatggttgaattgcaagatggggaagcaaacgttttcccaccttaaattctaatttagttagagctaaaaatcctaaacaatgggagcctagatctaggaggattattggatttgatgtgggtcattttgaccactacgaggaggattagataaggtccaaaagcaagatctgtgataccaaaagttcaaatcatgtgccaaacttcaaaagataataatttagtcatacgatgcccaatacccaattgatatgatcttttgttttaaaattgaatatcttttcgagatctacaattttaaacaaatccctaagaggactaaatcaagccaaaattgcattgtttgggcctcgaaataggttggccatactgaaactttttttttcaagaaagattttgaccaaaggttatcttccaattcataaagaactagatatagtgacagcagacaaaattgatatagaagtcgaaatctacctcctataaaattttaatatttttataattttttgtattaatcatattttttcagaaacttagtcgtattcgaattagaaagaagaatccaataaatatacatgaaaaaaaaaagattctaattatttaattataattataaaaattatgtactaaaattaaaataattagtaataaaatttaataatataaataaaataaataaaaaatatgtatataatatgaataaaaaagtgaagaagtattataattttgtcaaaaaaaattaatgaaagataattttgtcagtgtaaaaatctatcttgtatgtgcttcatccatctttccttgcatctttctaatttagaagtatataaattagtggagcacggtggatgggcaatcccttatttttatccatcaattctaaattttttcaaactaaatgataaatagaaataatccacccttcaaatctcatccatgctccatcacgaccccaactaaatatacagtaaaagtgtgaagtggttaattaataatgtcagcaacctgcacataggcctttttgagaagtagtgagaacagtcgactcgcgcggtgggtgaatttgatagttatctggcacaaagagtttgtattaaccatcaccgttccgtctatccaaaaaaaaaaaaactgtcctccttccattaccgttagctcttttaatgtttttttgttaaactttatttaagccatttccagctttctggctcgtgttttcgtagctcatttgttcggcttcttggtcgtatgaccagcattcgcaggaattttattaattttttcgaatagcatcctgtattcttactttcaagcatatttagtatgtagatagtatttgtgtctactatatattcaaggtgctgttgaacttggttgtgctgttcgcccagttgcggtaaggtacatcaaggattttgtggatgccttctggaaggctaagaagataggaaagcataccgagcttttattgaactatcttttcttccaccagcatttatcgtatcataaaagctttctttgactatcttttcttccaccagcatatagcaagagttactttgatctttgaagatttcaaaatcaaaataaacccaatttaaataagttatacatttatatctttaaatattatctatttaaacatttaaaaaatatttaaaaaattatttctgtaaatgttctaatatagatgtttctcattccaaattttctaattaatttatgtatacaaacaataatatgtcgcatatttcttgcaatatctatatcattaacaaagttgaaaaaatgaacaaccacttactcctaatatttttttcacaggatcaaccttattgttgaaagagttcaactccctcactacaggaagaattcaactttcctccaatccaaaaaaaaatagataccaaagaacttcataaacatccaacgtagatacatatccagaatagattttcgaagctagatgcaagtgtccagataacattgcaacaaacaagatgggtttgaacaggatgcacacacggaacattactttaaaataatatatgataagttgaacgcaggccttctggcctttagcaggcacatgagagcgtgatgatgatgtttgtttttttataatgacctttttcttggagcaattgccacttatgatggctgtgtggcctggcccagcttggtcaattgaccagctagaatagcccatatgaggcccagtcttttagcctggcttattagtggcgcatgactcggaacagcctgccccaagttcatcagggcagtgcccgagttcgattaggtggcggcaaaactccaatggtaggtaaacttgctggccgtaaacgccccttctgctctccataccccaagcccccttctccttctcatgctttatccgaggtagtaaactaagaataaaacttaatcaaaatgtgagtactcacttgggctactgttgctgctaaggtcgtaggctcgtagcgaatgctcaaggatttggttttcttggattgtaatttgctgcatggttgtacccttttgcaaccaatagacatatatacacacatccatacacccatagtctggaactcgtatgcaaattgttagtggcatccatgatgcgaattaaagagcaaattgtaaaaatttcggcaacacagtacatgaaattagatagtgaaacaccttaaagaattttaaaaaccctttccctttagtgaaggaaggaaaaaaaaaagaaaagaaaaagaaaaatgtccgtacaacaaacacgcaagttgacaaatttccttcatgatcgttagtagatcacccatttccaagtacctgaatcaagacgacaagtagataatgaaaagttttaaaatctggacctcggaataaaatgtgattgggaattaaaaatgaaaaagttcaacaaacgaaatggatatctacaagtctacaattataaatgaaacagaatctaacgaaaatagaacacaattaaattgggcaatcccgcaaaacaatttcctaaaagctttttcctttttttttttccaacattcccaagacagaatcttagaatttcttccttttatcggcagtaaacagagagatcatgcataagagctcggatcccctccagtctagctggttctccaaccaatagacatcctatggaacttcattttacaagataataaaaatttactaaatttatttctgctgcagcttcaaaataaaaaggaaggaagaactatatgtggtgttttcaggatcgaatggcacccatataaatcaagccagagaccaggatagccacataaatttaatctagcgcccgagccattatgcttagaggaactattgccatccactagaattggtaatggacgcgttcacaaatcttccctatcaaccacgattacgagcaggctaacatggtatatacttgtactattaactactgacattatttcaatagaaaaagattcatttaccacatataagaaaaaaacaatattggaatgtaatttaacaaaaatattgtcaaaaaccagataaacataaaaacacgaagccgaaaaaaaaaaaagatagattaaggggaattatgtagtgctcagacagccaagggtttgtcttcaactgctggtattatataccagatcagaaactctagtccacgatatcctcatcactgcaccaaaataacggtaaaaaaatctaagagaaatcatagaaatacgtaaaaatatgtataaacagcaatagattggtgggacacaacgccgaagtaagaaaaattaaagaaagaaaaatgaagcgaaagagattgcaatcctgtcgccacaaaatggcctgagactccgggaaggcaaaggaataaaaaggcggcctactcgggggatgcggcaccgagcatatatatagagagtctgtctgtgggtacaagtcagctagggtttgccatctaatatatcaaggccctccaattggcatctaacggctggtcgtccccatcgatcgcctcgataggagatggggctcgtaaatgggtcggataaaatctcgacctggtgacaacagaatagaaaagaggggagaaataggctcaccacagtgattaaatctcgtccgtccgttcttgcatcaatcaaattcaatatcaatatgtgagtaaaatatatacagcagagccgccgaggaccatgattgagcgggaagagaggaccagcggaacagcggaactaaggcggatccccttcttcgcggtcttcttacctgcggcatcgacctgcacatcaccggccaggcgcaccgagtggtggcgggtcttccgcccgaagaccttgtaccgaaaagcagactccaacccgacccggaagacggcggtcccgttggtgactgccgccgcccagggggccctcgccaccgggaaaccagggccggagaaggtgccggacttgtcggcggtcttctggtggccctggtagaaggcggggatgagggcggcgccggcggcggaggaggagttgggtaagaaggagagggagatgttaagggggtcgtggtagatgcccatctccttgttcttgttctcgatctcgaggacgaaggaggcgattgggtcaccggggaggagctttaaggcggtggagttggcgccggcggcgagggagaaggaggtgacgtagaagcggggtttgatggggcggtaggagagccagaggaagagggcgatgaagcccatggtgagctggcaccccacgcaccagcggcacaggcctccggcttcggacatgatcggccctcctccccttctctcggaattggagagcttttacttttctaaagtgaaaataagaatttgatgccgtagcaccaaggtacttctctccatcaactaccgtctatttaggcaggtcttactgattgaaaatgggcgatttggtgatgatttacgctgatttggttggatagaattaatgttcgtctctcactacatgaaatcataaaaataacctcttgtggaatgacgaggaacgtttgccgcttcggattgcgtgtcgtggatgaggaaaagttatcgtgtgattcaccaatcattttacaaagttgggcatccatcagcatctatcgaggaattatatctactataaataacaaagaagttattagcgctttctaatttataatagttcctaccagattatatatatttttaaattcttgattcagttaatataataaagaatctggtgtgggtccaccataagtttttaaattcttgattcaaaatgtaataaagaacctgctgtgcgtcccccaagtgaccataacttggtccatgtcaactagatttgatccagctggactcttgcgatccggaccatttctttcaccggtgcgcacatgaccaatatttccatcatcacgtgcataacaaccgcccacaacagttgtgcacaatatgggtgtgaatgatccgatcccattatcgaatgccacggttaaatcccaaaaattcaaatcatggttgacaatgtctcctctatataaagaagagagaagggaatcaatcctaaatcatctccaccctctctcccttccgactattttaagtctccagttgatgaagcatcaaaggtttccatcggacacactgcggcaagtaggttttggttccaaatcgtatgtaggtgtacctccagctccattcatccaactcagtccgtcgcagatcttagtcatgagttttgtgacaacagaatcaattttcagtaactttggatagaagaaaatgtacttcctcccatagattttagagtagggttgtcatgatataattattctctcaatgcatggactatttattagaaggcaagatgacttctatgcgacatgtttaccgcaaacgaagagacggtgcaagcaaatggccttagagggatttgggacgaaagtggggcttcgtgaacttcgtttcattttcggggcagagtgatcttatgatttttgacaaattgcagaggaagagggagattgagtacttttttttgcatgtacgatagccgtcacccaataattctgaaagaccaccctgaaacctccttccaggaaaaaaatgaaaaaggatgtttaatgtaggctccttggatacagctatcatagatgattacaacttgatcatttggtacttttgcatgcaaattcgttgcttaagatacgtaatgtaaaatttatttaaaaattaaacaagcaatccttttaggccagtatttgggcgaataacttgtgtttgtgccccacatgcgagacaaaacaataaaattctttattgccttaaagttctgttaggattcctattagacttttatcgtcagctttatgaattttggatctaaaattccaccgtttctatctgcccttttactaatacatattaaaatttaacgtcttgagattcgatctatattgagctcatagcgaggtccgtaataaaaaatggagttccatgagttcaagatcatccgaaacaaagtctggatgaaggagatacgtctgattgaaattggcacgaaatctgaaacggtagaggatcggtggtgggccggtggagcggcggtggtacggtcgtacgtggcggtacgtagctcaggcacggcagcgtgcagctcgatcgtggcaggacgccgcccagcgcgcagagcaggcccaggtctggccgtatgcacgcggggcacggcccaggcccacgcgtgcttgtgagggagcccagatagcccgatccactgtggatcaggcagtgcatagagggccttgtggatagagggggtgtttcccctcagtttctcacgatccacggtggaccgaacgccgtttcctcgacgtttcttgcggtctacgggctcttttcgcggaccgatgcacgatcgggaggtttgaaatgctaccggttgtgatccaacagttcagggggttttctgagtgctgtaaggaaatagtttcctaatctaactggatttctaagcctttaagaggcctgtacataggaactaaggatggcgtggtgcatggctttgatcggtgaagaacccagaacagaagcgagcaccgagaggagcaggaacagaggcttcagggaggctattggatagcagacagcggtcgcttcaaaggttcagaaggtcttcgtagaaagaaaacttttgtgagggagaacttcttgtgaaggagagattggatgtacaagggttgagggagtgatcttctcttataattttttttctcttttctcatagtgaagtttgcatgccctgtggaggcgagtccttttttggctgatccacgtatttgattgtttctgttttatttcttctttctttctgctgcaacgtgcggtaccgaaaaggtcctgggaggtagtgtcctggccagacatccaccatcaagtggtatcagagcgaggcggtacaaagatgcagattacagtggtggtgagcaagattgaagatggagaagacaggatcaatcaagatagagatcaacaagtttgatggaaagagtaatttctccttgtagcgataagggtgaaggacgtgcttatccaataagagttgattgatgctctcttatgcgagaataagctgaccaccatagaggtgcaagattaaaggtggctccagatgcaggtggtgagtaccatccgcatgtatctaatggatgaagtgataatctatgtgcctagcgagacttccctgacggtgctgtagtcgaagctcgaaaagttgcatatggcaaaatctctcactaatactcttttttttctgaaggcatttttgccagctgcagatgactgagggacaaaacgtgcggagcatctcagctacttccataagatcctcaccgacctcctcagcgttggtgagaaagttaaggagaagatcagagtgctggtcttactagcgtcgctcccccttcatatgagtctttggtgactgctcttttagtggagaaaagcaccatcaagatggacgaggtcaccacggtgattctccagaatgaggttctcaagagggagaacctagcttcgagctcaagtgacagtagctcagctttgatagtttctggaggagtaggagacggtagacaggatgataggagatcacgatgagggcggtccaagtccaggatgagaaacttgagcaagactagatgttactggtgtgacgagttggggcatctagtcagagattgcttccaactcagagatcggatgagagctactgtagcaacggccagtagcgattcaaagggtgatgtcctaaagatatctgacgaggtatctatttcttctcgacggtgcattttagattttgcatgcacctattatatacattgcagagtagtttgcctttctagagaacagtgatagtactgtttatctatcagatggatcgaactgtgcgatcaaaggcatcggaacggtcagttggaggacatatgatggtgcagtgagaaaattaggagagatccgatacatatctgatttcnnnnnnnnnnnnnnnnnnnnagctgatggagaaatttgaaggtgctacgcagcaatatgattgttgagggaaaaagaagatgagaggatattactatccgatggggagctcagtacgaggtggagcttcaggagccagaaggagcccaaagcaaggtggagctctagatggagatggatcgggtacaagatatgagacttgaaaagatgaaagatgatatcacaaggtgagattcctattgttgcaggatgataccccgagcaggtctcaagtcaggaagagcacagcatacgatggagataggatcgagcagtctggctcgagtcccatgtttgcctatccatgatcagcaggtgattaccccaggacataggggcgaggtgatcaagaagctctcagagttaggaggagatcgaatgtcgaatcgaagtagagattgttagaatttgacatcttgagatttgatctatattgagtctacagcgagatccatgatgaaaaatggagtccaacgaattcaaaaccatccgaaacaaagtccagatgaaggagatacgtccgattgaagttggcacaaagtccggagcagcggaggatcgacggcggtcggtggcgggccgacggaacggcggtggagcggccgcgcactgcccaggcatggcaacgtgcggcccgggtgggcctagtgcacagagcatggcccaggactgggcgcacgcacaaggcgcggccctggcccgcacgcccgcgcgggagcccgaatagcccggtccaccgtggaccgggcggtgcatagagggccttgtggaccgagggggtgttttcccttggtttctcaaggtccatgatggaccgaatgccatttcctcggcgtttctcacaatctacggactcttctcgtggacaagtgcgtgatcgagtggtctgagacgttgtcggtcatgattcaacagtttaaggggttttctgggtgttgtaaggaaacaatgtcctaatctaactgggtttttaagcctttaagaggcctatacacaggaactgaggatggcgtgttgcgtggctttgatcggtgaagaatctagaacagaagagagtgctgagaggagcaggaacagaggcttcagggaggccgttggatagcggacagcgatcgcttcaggggttcagggaggtcttcctagagagagcttttgtgagaaaaaaactttctgtgagggagagattgggtgtacaagagttgagggtgtgatctcctcttgtaatttttcttctcttttctcatagtgaaatttgcatgcctcgtggaggcgagctcttttttggctgatccatgtatttgattatttctgttttatttcttctttcttcctgctgcaatgcatggtatcgaaaagatcctgagaggtagtatcttgactagacatccaccatcaatgcactcttggccaaagtgtcaatgatcttccatggagtctcatgttggcctgagtttatatcgtttcagattgacaggtctaaattttaccgggataacaagagaggcaatctgaattatttgtccagatatttgagatgtaacattcaagtggactcaaacccttcttaattttcaggagtgtgatagctgaagcatcagccaatttgtgtaactatattgtcgttgtttaagtggattgactgaaaagatttgagttcttgaagtgcgactgaactcgattcagccattgagcagctaatcactaggagagatgcttccatacaactgcatgtcctcttggttttgtagtgtgttaggtattcgggcttcctgtgacctttgcttggtgcaatgtcttttctgccacttgttggctgagctttttagaatggatgttacagactggtactggtctagttttcatttgttcaaccaattgcttctggtaggaagaaggaagcttcgcacaaatctttgatcggctgaagcatcatcttatatactatgttttagatggagcaagtgtctatttcagacaaaatgagaatttgagcagtagctcgctgaagaatagaatttccattaaatggtcacaatcattcatcattctagtcatcggaggttctgtatcatgctggtggaacgcaaacagcagtacacaatatgaagcatcttctccctacgtaattacagatggcttcttctattataaattaagcacgattttgaagtcctgaagtatctttaatttctgacgtcttgataccttcacctcttcatcttgttattgctaggtactaaagcttgagtaaagttgaaacaccttgtctatctattttgcttatcttattttgttgtttgtatctttaaattcgatcatttgtaaacttttatattactttgttttgattttattatggcttgacatcatatttatttggttaattttgacatagttgaactaccttattttttgtgataaacaccagcttattttccttttttttgatgcaaacgggaggtactacccccattttattagattaaaatgattagaatttatggatacagtttcaaagagcaattagctctatttagagcccaacacaaagaaaaagatttatggacaataatagaacccatattccacctaaagaagaaactttatggacaaaacaaaactcatatcccaccccaagaagaaactttagggagtgggatgcatggcgaaggattgcaatctattccataactcttgatgttatatctgaaacttaatacaacccagatgccttcaatcaaaaaaggattggagcagcttttgtaaggctgagaatactgaattcttcttatttagaagatatggatgtttctctccctcagctcccaacaagcagctgcaaaaagttgataccccatcttctttgcccacttgcccttgttctttcctttccagtatgtccaaagatcaagaaagttaactggtcttcctttaagattcaactgtaattttatggttgtccttatactccttgtagatgagcaatggaagaaaaaatgattaatagactcaaagttggcaccacaaaagcaacaaccaatactaatattccaacacttcctagcaagtacttcaccggtttgtaacttattcttggctgccaaccataaaaatactttaattttctctggactcggtgtttttcaaattgcattttgaaaaggacatctcaaaccaccaaaatttaggaacttgtaaaaaaaataataataaaaaagatcattgtgtaccagcctctaaataggaacatctgcaatacgagacgataccatagaagaaagaaggttattcaacaactgaaaccgatatgactcatatcttgtcaaaagatctatcaacaggacataccacctcaacgtgctcatattccaaaatgatgcaaccgacaagttaaacttcaatatctgtacataaagatcatcaaaactataattaagaagaatttcatcaacctaagcatcttcccagaatctaattgacctcccgttgccgcatttaaaagccacacaatttcaaaaagcttcattcttcaaactaatatccttccaaatagaagatagccccaaaatgttctcgttggcattccaaacttctttcttgagtagtaagctcttgcaatttggtgctaccaagaaccatttgccccatgaagaaaccttcaagaccatttagcaagcaaagaattgttcaattgggacaagtttttgatacctaaatccccttgatctttagacttacaaacaacctcccagctcaccaggcagtgaaacccactaatttcattacaaccttttcataaaaaagcttttctcatcttgtcaattctgctaataacctaagttgacaatctgaagatggacatataatatgaaggtagggtcgacatcacagcattgatcaaggttaacctgcctccccatgaaagtaactttcttttctaagtagaaagtctcgcactcactttttcaattaaaggtaaccaaccttgcttgagaagcttcctaaaatgcaaaggtaggcccaaataaatgaatgaaaaatcttcttttttgctgttcaaccaagatgcaaactttgaagcctcccatcattcatgttcaggtaatgaatggagttcttgtagaagttaattttcaacccagaagtagtttcaaatgccaacaagatggccttggctaccaacatgcttccctatttttcagcacaaaataaaagtatatcatctgcaaactgtaagctcaaaatacccctgtactccttaaggtcaccaattccttcaattaaccctaatgcatcccctcttttgagcaatcgagtaagaacatccactgcaagactgaagaggaaaagtgagattggatccccttgcctaaggccttacttgcattttatccatctactaggagaaccattcactaatagagaaatggaggctgatgaaagaagacgacgaatccattcaatccatccgataagaaagtctctagcatgcagcacttcaaaaagaaactcttagttcaatttgtcaaaaatcttttcaaagtccaacttacaaagcaaccatttttcacctgtgcacttgcaatatgccaccatctcatgtatgctgaggaagcaatcaatgatatgtctcccatttacaaatgctgactgatattgttataatcttggttataatctttgttataatcttgtagaggcaatttaggaggcaaattggcctaaggtccttggctaatgggaccttccttcttcgggataagagtgatgaaggcaaagttgagacggttcaagttaaggtgtactctataaaactctcccaaaaggataaataagtcattccttcatagtaaatccatcggggtctggatctttgctaccgtcaaatgaaaacactgcctctctaatttcctccatagtaaaggcattcactaactcagatagatcggggtggcgagtcaaaaagtaggctccaattgatctttaacttaagtgctgttttccatccaaagaaattcttaaagaatgagtaaaaaatagaaacaatgtccttctgattagaaaactcaacaccgccatctaacaaaacatcaagatgattctttctttttctacttgatgccactttataaaagaatgaggtattcttatcaccttcttttagtcaagtaatctttgattgttgcttccaatagatttcttctactgggcttccaatagatttcttctattggaagagcagctgtttataggaagtgtccaatggctatctatctataaaaggtctacataacagtttgcactctggataatatgcactgtgatgaaagtcatagaaatctaatcaagctcttttgttttagcatttgttatattctctggataaatggttgctgtatttcctctttcattgactacatggtcgttaaccacaataaagattctactgcagttttataatgcaacaagtatctaagataaaacgtttggttgccttttctttcaatccagaaaatggattaaagtctgtgaacaattccttattatcatttgctcatatcttctcatgaattggaaactaataaaagaacaaggactaatttttgaaagggctaaacaaagatagaaagtctgcatctctgtctggcaacatccagttcacatgatgagtcttgatgagcaaccgaatggtctaaacgacactggtggaaaataagtaaaacagagtatcatctaaaccttaatgagctctcccatcttccccttcaaaaaactacccatcgtgcaaatagtaagagtgatttatttacacaattttgatttcaaaagtgaataggaaagtaagaaaaatgagtgaaccatgccactcatcttttgctacgcctttatttagttgaattgttcaacaagaatccaggactctggcctgttgcatgatactcctcttctgggcccatgccctgtgtgttgtgacttaaaaactataaggccagtttgttgttcaatacagggttgatctagcagttactactttctttacccagcttctttcttcttactactacaaggccagtctattatttaatatagggttgatctaacactcaactactttcaagttctttctcttattcttctttatctacgtggggctattccccatcttttccattttggactaagaaggatcctcaccttttccatcctatatttcttcttggaatgtgaccttaatgggaatcgaaacctgatctcttgcccaagtggcaagaggtgacatcatggagcaaggacatggttgtcttttcttctctgtttcccctgttttcatcttttgtttatagtggaagtgctattcccacccgttttattctttcaataaaagttgcggcgcatcattctatctcttttcaatagaaaagaggaatcactttttatacattatttagactgctccaccaatgattcattattttttttagaatccattgcttccttctttcttctttttaataggaagaaggaagcttcgcacaaatttttgatcgaccgaagcatcatcttatatactatgttttagatggagcaattgtctatttcagacaaaatgagaatttgagcagtagctcgcggaagaatagaatttccattaaatggccacaatcattcatcatcctagtcatcagaggttctatatcatcctggtggaacacaaacaacagtacaaaacatgaagcatcttcaccctacttaattacaggcggtttcttctattataaagcacgactttgaagtccttaagtgtatctttaatttctgatgtcttgataccttccacctgtccatcttgttattgctaagtactaaagcttgagtaaagtcgaaacaccttgtctatctattttgctcatcttattttgttgtttatatctttaaattcaatcatttataaacttttatattacattgttttgattttattctggcttgacatcatatttatttggttgttctgatctagttgaaccatcttattttcactatgctttggttctggaaaggagcacctgttcatagaaagtgtctaatgtctatctatctataaaaggtctccatgacagtttgcactctggataatatgcactgtgatgaaagtcatagaaatctaacccagctcttttgttttagcatttgttatattctctggataaatggttgctgtgttccatctttcattgactgcaaggtcgctaaccacaataaagattctactgcagttttgtaatgcaacaagtatctaagataaaacttttggttgccctttctttcaacccaaaaaatggattaaagtctgtgagcaattccttaccatcatttgcttatatcttctcatgaattggaaaccaataaaagcacaaggactagtttttgaaagggttaaacaaagatagaaactctgcatttccgtctggcaacatccagttcacatgatgagtacaactgaatcgtcaaaacgaaactgaaggcaaataagtaaaacagagtttcatctaaaccttaattagctctcccatcttccccttcaaaaaactacccatcgtgcaaatagtaagagtgacttatttacataattttgatttcaaaagagaataggaaagtaagaaaaatgagtgaaccaatgccactaatctattgctacgcctttatttagttgaattgttcaacaagcatccaggactcgggcctattgaatgacactcctcttcagggcccatgccctgtgcgttgtgacttaaaaactataaggccagtatgttgttcaatacagggttgatctagcactcacttttactttactcagcttctttcttcttttccttcttcttcttcttactactacaaggccagtctattatttaatatagggctgatctagcactcactactttcatcttctttccctcaatcttctttatctaggtggggttattccccatcttttccatttgggactaagaaggctcatccttaccttttccatcctatacttactcttggaatgtgaccttaatgggaatcgaatcctgatctcttgcccaagtggcaagaggtgacatcatggagcaaggacatggttgtctcttcttctctgtttcccctgttttcatcttttgtttatagtggaagtgctatccccacccgttttattgtttcaataaaatttgcggcgcatcattctatctctttttaacagaaaaaggaatcactttttataccttatttagactgctccaccagtgattcattttgtttcaaaaaaaaaaaaaaccattgcttcctcctctcttcgtgcacgcggcgaagagtgaaaatcaactaaattttttgacatatttatcagaaaaaaaatattgttgcagattaaattacagtatatattacagagcactctaatgattaaatttgaagatcattgtctgatcttgcgagattttgtatatcttatttttttggactgctctcgtatcattgttacgatcgtctgccagtatcaaaaaaaatcaattaaaattataaatatatttaataaatcaaataatgaataaaaaaattattgtgtagtgggatcacatccatctatcagatgctccctattcttagtacgacacattattttggtgcatacaaaacagtacaaacaatgtaatgttacaatcacacgagagatgtgagaccaagttagaagggggctaatcacacaaacaagttacagcattacaagcttccgaagtagatggagcacctcttgtccctgtacccagccaggaggttgccatcggaacccaccacgacgtcgcactgcacgtgcaacgtatggtggtgcgtgtcccaagtcttcaccctgaaccgaatgaccgatttcaactcgagccggaactcgacccggccggccgccgcgtcacccgacagctccgccgccagcgcgtcccccgccgcaggcgccgtgccggtgagatccccgacaaccaccgtggtgttcttgtgcggctggtagaacgggttcaggaccggaccggacccgaccagctggtccctgtggtagaccgaggcgtaaacgacgtcgtagtagatgccgatgttcccgttcgggttgcggtccgtgacgttgaaggagatgggcgagttgaggagggcggacggcggctgggcgacggcgggaacggagaaggaggagaggtagaagcgggggcggtgggggcggaggctgagccagaggatgaagacgatgacgccggcgaagaggaggagggagaggagaaccgagcagacgcacatggcgaaccgcgttgtcaggctctcccggacccggctggcgctgaaccgatggtgatgggaccgggtttgggtcgggaccggtgaccggaacgcggacgacatttatgcgacttcggagcaaggtaggtttctcgtgaatggacggcgacgggatacttttatagaagtggggagaggacggagatggtaagctgtggaggctgtcggagttggggagatttttttttttcgaagcttttttttttttaagaaaaaacttttgctctttcactttgtttgggctgatgaagaaaggaatattaatattcctccactgaaactttgcttctttcttgttcgttaagctgatccttgaaccaaactaaattgaaccccatcccgagttggtctggagcgtggggttgaaccaattcagttttaggttaaatcatgcattataaaagttatccatgctcctgactcctccattttaatcaccgctcccctttatgttccacgtaggaccaatgaaattagcaatactacctttttttttttttttgggtaagatactatcttatttttttaaaaaaaaatgaaatatgactacttcaattttgaacctaggatatcttctaaaacaagattagatttttttgctaccaaaatctagtccgattatagtggcttgaaagacaccgatcaatctgttgatctacaataagaaagaaaagaaaaactcgctagattagctccgatcaaatcttctgatgcctaaatttgattgagttttagaaaaacaaccataaagaaaatataatagagaattagagtagtataaaatattatcttgttctagtcggtttgattctaattgatcttcttgggttggactttttacatcagtctttagaagctcagcttcgggaggtcggtctttggacttttgggaggttagcttttggagatcggcctttgagagctcaacttcgagaggttggcttttaggaattcaattttgagagcttggctttggaattcaccttcgcctcagatttcacctcagccttaggcttgatcatcaccttggcctcaagctttacctcggtctcgatcttggtctccacttcggtctcagccttggacttcattttgatctctaccttggcctcaacctttacctcaatcttgatcttgggtttcatcttgattgcttgtagacctgtagacctacaagaaagaaagaaaagaggagtgatagttgagagctggagagcctcacgctatcaaagctttgaattataagattttcgctccttaggagatgtttggtgatccaacttggatcagcagggcgatctaaaatcactgatgatccaaatcctgggatgatctaatctctagtgatctaagatcactatgtttgatttacctagtgtagtgattaaagatttctggatatatacaagctacttgtttggtacgctatgggaattcaagatcacagactatataatactaaaattacccctgacaacttacttgggagttggaattgagaattaggataaaaaatattttagaataaaatcaaatagattttatctctttttaataagtatgctgagggaatgaaggatttccttctttttcataaagatgatggcccaggcatttgcatgcatttcttctctttcgtaaaaaagacatctcaattatccaccccacgcacataaaaaaaatatcatggcaaaaaaaattttttttttctcttgccgaaagtctctcaatcataaagatattttggttaatatattttaatataagatcaccataatcgagtgatgttggatatccgtccttcagaacagattttctatcattgcattggacggtgatttaagaagtggaggtgatttgaaatcactgccatataggattactatggtgtaatcaaatctgataatctcatcacctccacccatatcacctttgatcctgggtggatcactttataccaaacgctctcagcatattttttttggatcccttagccttatttatataggtgtagaacaaaaattcgttataattagaaataaaaattagtggatgagacataactcctcctttgtaaactatcactttctttcttatgagccataactatctttccatttttggattcctcctaatcgcaaagtcatgactatctaaattcaaatctttatagaattgcttgccacatatccaatcacgatagataggccaatttatatgtcatataaagtaccaaattgttggttaacatttagcagtttttctgataagaatataatttaatttctctagacgttgtaacatggaaaggcgcaacagaaaattagctaactattttttttggtaaaaaaaaattatctaactattaaaatatttttataggcaagatatcatggccatgcatccttccttgcttttagctacaaccattgttcatggacatcatattttcattgaagtagtctataattggtttaaaaattttgaagtaggttcacctttaggttcttcttgcatcaagtttacatggatgttgatttaaatccggtcacttattgtgggctgggtaggtcgtggtccaaagagagagagaatcaataaccatcaagtatcctttccgtggtgtaactctgaacaccagagagcagatacgcgagagcagaaaagaaagcactcagaggggatgaagtaccaccttaagcttgtaatgctgtaaagtacattttacgtaatatctttcggtcctttaaacctttagtatcccccaaacttaagccttgggtcacttgtggatcaatgatgtcaaatttatacggatataagttggatctctcatattaaaaaaataattaatcttctttcacaacgttaatcattaaattacatccaatataaatctcaaaatatatttaatttttttatttatctacctgtataaattttaaaatagcgattaagcaatccaatggtggacccttgtgcaggaaggtggatctttcttttgtgcaaaagattcaaccctgtccagggtgcacgttagcccaattctatttcttgcccaataaagattggcaggattgcccaattctatttctgaacatgactgggtcacagctcagtcgcttggatcagacattgtctcattcaggctgctaaatttaacaagttaaactgcagtcaaaattttcaggtatatcttatgaataacttgtgatgggacaccttgtgaggtttccatgcattaggattaattttttgcttacattatggtgctttaaagaaatccctatagttccgccccctcatgattcaaagtttgagacatatatttttttaagactcatttcgcccacgaaaaatatttatttttttaaaaaataattttttaaaaatatgattttcatacgtttgatcgaccataaaaagatagcttatttaaaaatagcttatattcgattaagcatctatttttttaaaaaaaattatataaaatatctattatatttttaatagatataaaataatatatttttgcatattataatatgatattagatcataataatttaatatattaatataaaattaatatatatattaacatatatattaatataatattaatattttaatataatacatgtatgaatctagatataaatataatattatactaatataaatattatattaatattaataaaaatattatattattattttataaaatttcaattatgaattttaaaagaattttttgaaaaaaaaagtcatcaatttctattatatggaaatctcaaaattcacctctcttatgaatttttatttttataaaatatgaaaactattttcttattaattttttttctattctttttcctcttaaatgctaatcgaagaagagggcttttttttcgcttctcaaaaaaaaaaaaaaaaaaaaaaaggaggcaatgtttgtagctggaagattactggatacttgatgcgttctccaactatgaaattttcattgtattgactatcaaggggatttcacgttcacttctttctcatatttacttcctttttgtgcaccgtgcctgctgaccgttgaggcaaccgccatgagagcaaagcaaagcaagtccgtttgtccggatatacgcagtgtccgtttgtccggatcatggacggtttttttttttaatatattttttaaatacttatttttcaatctatttttttttcaacttattttttaaaatataataatttgaataagatggtgcaaacatggcgaaaccgcatgtagacctagaagtgggttcggaccagcctaaggcccatcgagccagaccggcttcgggccgggctttgatctcggcccaaaactattcgggccaggctcaggcagacctttcgctcgacctgagcccgacccaggcccaagcccaaagtcaggcccgatattctttctgccctccagcccctcctccgtctttgcctggactccggtacaatcaaatcggagtgggaagtctccctcttgatcggagggagccgctattggaaaaagatgatgcgtcgatgccgaagatggaggcggcggtggacttggctgtgggagatggtggctgcgatagaggggagtcgaaagcgttgatggtggtggagctcttcgatcatcagctctagagatctcaatcttggagcgccttgctcggatcctctcggaagaagttcgaaaagacgatcaacttcagattgctcgcaatccgcgacagatcctgctagattgtgtcccagatgggctccgtcaatgtgttgggcggcgatctgaagccgtcggccgcaatgccgccgtaggagctctcgacggaggggacgctcggcggcacagcaatgggagccttctggtaggcagcattctttggtactctattccccccaccgacctccccctcccgctcctccctcctctcccttgcctccaaccatcccctccctccgcaataggctcgcccagaccctattgggtttggaccttatatagatttggaagcggactagcccatttgagttcaagccggtctcgggcccgggctcaagccgggctcagacttgtatttttttcaaaaaaatcgagtctaagcctgactcaaagcccaaaaaattatttcaggctgagctcgggcaggggtagaacccgatcaggcccggcccagttccagccctaatcgtatgttgaaaatgcggttctgcttgaaacctcatctttaacatgtggtttcaaataagatggataaaaaattaaaatttaattttaattttaaaattaaaattgaaaccgcatattggacataccgttttagttttctagatgaaatcgcatcttcaagatgcgattttttttttttttatcgttttagaatgcggttattttttttcatttccgacggcggcgccacccgcggccctgtcccgctgccgtcctctttgccgtccgctgcggccctgctccactaccatctgcccccaactttgcatgaccacacccctctcccctcctccgggcctcgacgtccatccgcacgaacacaaaagccgccccccaccacccggaaccccttgcacccttcctccgccgctgcgcccgcaccccacgtcccccggcgccgcacgccattgcccccaccattggccactaccccagccgaccggtgtttcccctcccctccctccccggtcccgacgaagcccctcggttcgatacgaagctgaaaataaaaaaaaataacggtgctctaaaatggcaaaaaaaaaagaaactacatattgaatatgcaatttcatcttgaaaattaaaaccacatattgaatatgtgattttaattttaaatttaaaattaaatttaaaattaaatttttttatctacctcatttgaaatcgcatgttgaagatgaagttttaagcagaaaccacatctttaatatgcagattcgtcacgtccgctccacatcatccaaaccaccgtattttgagaaataagttggaaagagggtagattgggaaataagtattaaaacataatatttaaaaaaaatctgatcatggactatttcaataatttttaataattatttatttaaaaaaaattattataaaaaattattatatttgattggtcaaaaattattttaaaaaataatattgaaaaaaaattactacatttggtttgaaataatcctatatgagaatgtagcgaaatttataaatatatctttcaatataaaataattttttaatatcaagatagcattatcatctccatcaatttaaatataatgactattatcatgtaatcttttgcataatactattttatcttaatttttttaacaaaaattttatattaaataaatttaaaaaaacatcagaataaattaaataattatataagtagctctattaaaaatatttttatcaaatatagattatcatcattcaaaaatttatcaaatatccatttttctacgaaaaataaatataaaatttattttttattttttatattaaatataataatttaatataaaatttatttttttatccaattattttcaggtcaaacaagtccgtagggaccgtggctatacccttagcgcggaagaagaacccatctttctttgtgcgaatccaccacgaggtcaccaactccactgatcgcgcaggcactgaaatccaccctcactgacgcgcacagattccagatcgcgcagtggatggtccgacggtagattccggcacaaggtggatccttctttcacgcgaacgatacaaatacaatcccgaagagtagtcaatgaagcctccagatgcttctagaagcttcttaaaagttcttcaaggttgtaaatatatatgtacagcagaacctatcccataggcttaagctaatgagaaagaagacaatgcagattaattgactttaacgttctacacaagatcaactgccggtattatcgggagtaacccgactttccactttccacagctcaccgtcaccggacattctcaattattttacaccaacaccctttaataaataccggctggaaaaagcctcccctttcatctaaaacaaaaaaaaagcaccctttaagtagcagttgtacgaggcatataatcacatggtggcaacacaagtccgtgttgaaagggttgactccagggctgcatccgaggactgttcatggaatactgcttcagctatcaaaatttttataacggtatttattgccgctaaattctgataggatcctcggttcgaggtcacgtgaattatttaaaaatttaaatttttttattaaaaattatttaaaaaaaatataaaaatgagaactttatatatctcccttaaaaaaaatttctttatccctcctcttttgttttcttatataacgccggcgtctgttgttgtcctctaatctctgtctttaaacttatagaaatatgaaagttaccatatttagataaatttaatcgacagttattatgactcacgatatctcagttatgagcagttgacatccgtatcatatatcgtaaccattcgttgaccatcgatctttcagatcgtgcgttacgattttttctcaaattctcgaccattaatcaaataggacaatcagttgaatattgatataatcatcgatttataaatgaccatattgccaaataagtcatttgatcagcatcgggttgaaatcattgatcgtcatctgaatagaattggcaatgcagctgatattcggccatagatcgaataagattgtcagaattcctccaagatcataatttcgaatatttacccctacaatactcttttataatattttattataaaaaatattttaaaaattacatcaccataaaatctaccattctcctcgtcgttgcccactgtcgcctcagctgccccctcctcatcctccttcgcccatctctcctttactaaggctgctcgtcgagcttcaaaacgttgaaatcagaattggaggatggaatcgttagatcttgagaaggagacaatcaaggcagtagagagaggcgactgcagcggtgcaatcaagatagtgagaaaaggacagggcttgatcagaggtgattgaggtggaggggagaggcggctatagcagttggaggtgaaggagaaagaagagggtcatataggacttgatcgcactagctggagattgagaagaaggtgatcaagccagccataacagtcagagatgaagaagtcgagggtggggcagactttgattgctggctggagattgagaaggagacagtaggagagaaggagccacagtggttggaggagaaaacgaagaagtggaggtgggcaagccttgattgctggccggagatggagaaagaggtggttggggcaggaggagaggggtggggcttgatcaatcaaggcgttgaggagagaggaggccataacgattggaagggaaggagaagaaaaattgagaaggaaagtgaaggaaggagaatggatttccacaatatccctaaactttttaattatttacaacatcaagtcatctttttattttcaaatcatttcaataatttagattatttactgtaccattcatgcacatggctggttaaaatcgattgtaggcggataaatgagtgcggtctatcttggatagtgttggtgcagaattccgtcgaagtcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgccgtagaaacttgggtaaagtctggttactgtagaaatctcattgtcggggaagctcggatgctgatgaagttcgaaagaagttcaggggtagtcggttgctgtagaaggtcggctaacagtggagacctgagggcctttggggtagcccagtggatgaatgcagaagttcattgtcaaagaagtctggatggttgaggaggttcggaaagatgccacacataaggtcgggagccggaagagccctggagggatcggtcttttataaacttcgaccgggggtactttatacccaacagacagaatagtcgaaaaaaataaataataaaaaaaataaaaagggctttggagtaccatggcaaaatccctaccatcaagaattttcggaaaaaatggaaatcaaaggtagaatggtcaattttagcgggtagcctgcggcatctgcagtgcatgtgagtgaaaacttaagtaggggcgtgtagaggataggatttgagtccaagagaaatcaatcttgtatgcatcacataactatggaacgagagaagttaaacctagatgtttgccttggtgttttactcaaaaaaaaaaaaagaagaaagccgaggcgtttgcattagtcccatatgataaagttgtctttttttttttttttgcttgaaagatgatagttttggttctttcacatttcacattttacagaatgaaaaagaatggttcatccaacgtttttgtccgaaattttcgtttttctttactgcaaaaagtggatgaaccaccaaaattaagttgatcgaaagaatgaaatgaggaacatattacataggacaatataatgaaagcgagcgggagagaatcttatgaaagtggcattcgcgcaagctcttgttcaagatatatataggcatcaacgcaggtcgttccttcaaagattctagtttttttggagcgctcagattctggttagcggaagacttagaagtatctttgctgatggaacaaccatcacataaaaatacaataacaaggacgggcgttatctttctaggtcagtacattgatatttttgtagacttagaattcgcagtgcgtatgtaaagccatctcatcaaagcatctactatgttaaattaataccttactatccttccgtgatgaaaaatcacaatatcttaattaggcagattaattacgtgcaagtggagttctctatcaatgcactggcaaaggcatgccaaacccggccactccccacaatttctcatttgaaaaagaataaaaattgaaacaaaggttaaaactctcactataattattgctgcatagcctagaatgaacgagcgcgatcggattcataaaaccatgtgggcaccttctcccagcactgaactggctctagaatcccaagaagcacagaagtgaagagtaagcaatccacctcccacaacttccagagaatcacatcgagttgatgaagtcctctaccacccataaaaggctctcacgcctctcttcgtagcactcaccatcttcctaaccaaatcgcagcacagaacggcctgctctcaaatggctgctgtcgccatagctctcctattagcccatcttctcaccactactctctctctagaaatccacttctatagaaactcatgccccagagctgaactcatagttagtcaagtggtcagaaggcatttccagcaagacccatcagtccctgctggcctacttcgcctatacttccatgattgttttgttagagtatgttaacttctcgtatcatatgtttcctcgtttctttagcttatcatccacctttttctttgatggattgtgattggtcagcgtccatgttgctgcaatagggctgcgatgcttcagttcttctcgacagcactgatgataacatagcagagaaggaggctgtaataacccagatttaaaaaaaaaaaaagggacggaaggagactcccaaagggagtcttcttctccgatgaatcccgatcggagaagaactctaggcctcttagaactctaggattctctataaataagactctcctctccctcacgagcctccaccggcgaccgtcgagcccgattcctctccttttctccgtagaagccgcgacagcctcttctcgtgttcgtcgaaaattgaaggtcgaagaggccaccggagttcaggtaaggttcaatctttcttcctctccctcttctctttcttcccatgattttagactcctcgccagccgttaggatcgtcggaaaatccatgaacaagaagatcctctgtttttcaaaaaaaaaaaagagctgccggccgtccgctgctggccaccgccggccgaaccccatcgccggccgttgtcggatctctagccaagccatcagagcctgagccacggggggggggggacctcacggtctttccctgtttcagccaagggaggccgcgggaagaagaagaaaagaagaagaagaagaaaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggtcgagatgtgagagaggctcctccaaatctaacactaagaacatttgatgtgatagatggcataaaggctgagctagagaaggaatgcaggggggtcgtatcgtgtgccgatatgctagcgctagccacaagggatgcggtggcgctatcagggggagccgcgtatgctcttcctactgggaggagggacgggatgatttctagaatggaagatgttcacttaccaagtcccactttctccgttcaagaagcactagatgccttcaaaagcataaatcttgacttgtgggatctcactacactgctaggtaaattgacctcattgtaagtagttcagtagtttgccatagaacatggtttacgttgatagagtagggtagattatggttttaggttgcttacaggtagatctgatttaaggttgtgatgcgcacttttttgtttcaagcctataatataaaaccccgagattttctcgaaaaatgtgataccttggatatgttaacagatgttaatccaactttccttgcactgtaataccttgaggtgtatgaatagcttgattccattcttgcttgcaggtcccatacatgtatgattggaattggctttatctatctctttttattatgttttcatcatttcaatgaagagcttgattaatttatgatatttttgcctgtatgattcatcaacaatcttttgattggcttgattttttttttttcgatttttaatagcaatacccaggatttgaactatagtccttcagttgtattggtttttcaatctgtgataaaggcatcataaccatcatcatggagtcaattctggttgcacattttattacatagttattatatatatcatgcagttatgctttttgtgaagttctcaagtcatgagacatggcatattgttctataacccttggatttattaactgtcaatttttattttgatcacaatcttccccggtagattttatgtatactgttattagagttcctgtcaggaaaacatttaaatagaactgtgagaaaaatttttaaactgtagatttacaagtgcaggaagagtagttaagcattatgtatggtgatgaaagaatgaaaaaaagcaggattgtagcttgtctcattctgcttccaaagccatccattctgcattgcactttttttttttttcatttttattggaggcaattctgcatacacattaacctttctctgttcctcaaatttggagttgatgaaaagttttggattctgtggccgtcagatttttgagaaaaattgaagttcataacacaaaggagtcctgcatgaaacactttgcatgcatgatcatcatctttctataaaataacatagtttggctgattctgttttttttcccttttcaaatttaggtgctcatagtgttggaatctgtcgctgtggattcttcaccgatcggctttacaacttcagggacactgagtcagctgatccacagattgaaccaagcttgctcgaaactctcaaacagatatgccctccgcatgttgtagaacttgcaaacataaccaaagacccaaaagtctccctgtgtcaagtttcctccactccttttactctagacaactcattttatcttggcgtgcttaataagaaggcaattctaaagctagaccaagagttggctttcgctgatctcacaggtagattagctgcgtaatatgccaacgatccaaaatttgtcaggagacacttttagagtccttgatcaaacttggaaatgtgggtgtgctcgcaggacagcaaggggagatcagactgaactgtcgcagagtaaatggtgatacatccaacaagttgagaaattcattgcatctcatggtctgtctttatattcttaattatctcagctggaagctcatatttttattatagttgcatcttaattcatgcgtgagttgtagacagtgagtcgaaccatgagagttcctccctctcacaatatattggcattcaggcaaactgttctacctcctactcctgtactaaaagcatccaagacttggaactatgacaatggctccatccattcatggttgcaattttttgtcacgcttgtaggttatccttccttggaaatttttgtctaaagggaagtcattagcttcaccaacaaagctgtgatgcattttacttctgcctatgttctggtctcttcttttcaaggatttattgtgccagagcctgctgttatataattgtatcttatgaggagaagggaggaatcttttaagttgtgccagagagtgaatgggtatctaacgatagcttccatttgattaatttcgaaagttcctctaccaatctccacctttaagcacataacgtttgttacagttgcttgaaagaactttcagacgatacagaaatgcttcatttgaaataagcaaaaagaacaaaaaagaaaaagcacaaatccttgcaggaagtctccttggagacaaattattcaccataaaactcacaaaccattggttgaagcgtactccttggagacaaatcattcaccataaaaatcacaaatcaaaaatggtcaaacaaaacttgcagccatctagctattcacgaccgcacagttcttcctaatttcacccgaagatcctgtctttacctcaatcctccccattttctccatagaaaaagcaaattctttgaagaatacttcaagaggactgctgacaagctccatgatagaagccttcgttgcagtattagtggttagagctgcatcagattggaggagacctcttctcttgagtaaatgtttgtagtatccaagatcaaaagttctgaagcttcccggatccatctcaacaatcgttgtcgtgtcattaggaactttgcacttgtacttcttcaaatttgcagcataaaagctatctagagaagggtcttcatcaccttttccagtgaaattgtaaaggcgactactgaacgatgagcagtgagagacaccaattgtatgagctcctgttgcgcagcatattagccttcatataatggaaaagatctatgctatacgaagcattaactacatgccattagcgacttaccagacaaaagtactaaatcttttaagtctagtcctttactagcgaaagatgtttggagagcactaaaattaaaagttggggctggaaggtttttcaaggcctctatggaatttgagatcaaaccatctcttcgcccggtgggaacattccagaagggacctccctggtgcaataagaaaagaacagcttcaatagttaagaagtttcagtatcagagaagtttccacaaccgtaggtaataaggaataaacctatggttaagtgaagattacgaatatcatacggccagctttcaaacctaacattgatcctataactttgtgccaacttcttgtacaaggccaacttcaggcaagagaatggccgagcaaattgcttgacatgccctactggttagttcagactcttgaaaccaactagtacctttaaggtcccttatacttgaaggtcaggcaagaaaggtagatttggcatcttgcattcatctctatggcacaaatcaaaagtcaatagagctgattgcatttcctaattattagatgaagtttcttcataaaaatgtaagccaaaaataagaaggaaagcaggaaaagaccagccaagtataggttccttactgtgacaacaacagaatctcttgcaaccagggcaagaatatcggcacatgaaacaacacccgggcattctgcttctattaagctcttgactctatcgatgaaatcgaaaccacgaatgcttagatttgggaatgctgatttctctgcttgattcttgctagtggagttaatcagaacagaagcatcacaaccctggaacaaaagagaattaacacacagcttatactaccatatggaagtaagaattgtgctgcatgcatttacataccctgacaaagcaatcatggaagtgcaccctaagaagaggagcagctaacgatggtgcatgaggtatatgtttcttaacatagtcgaatataatcttctcagcctttggacaagtctcatcatagaaacccaacttgagatcagcatttgcacaaaataaactcaacgctacacatatcacaaaacactggatgcttgtcttcctcattgctctaagtaaagataaatcgcaaaacttgatcagtagttgaatgcaaaagggccttgctactctctttatgttctatgtgcttcaatagaactcaacatccagagatttataggcctcccctctgttttttgtccattagcgtgttgcagttttcttcatgagagcagatgctgtcctattagctgagagcgagcttctttggcaaagttgggtatataaggtctgatccgtggaccagtcttaggtgtctcactcacttttgttgtggggtcttcaagtaaatgtattcattatatgttttcggtagatatctaacttcaaaagaaatcaagacttcacccactccttttcgtagaactgaaaaatgcactcttttggtttatgattgaactggtggcacgtgagcagtgttttggttaaaccaactggtcttcgttagctggccctttttcctattatgtttgtcatctattaatgggatacgaccttaccacattacagatcatgtgtctgtctaattaatctaccattgtcactatcattacagatcatgtgtaactctactgatatgcaaattgtgtgcacgccaagttcgtacccacttcacaagggatacaattttgtatttcaacactaaattggttaggattgggccatgctaactatgattctccataaattcaaaccttttttttttatccctttttgtttctctctttcggtgcaattagtaagatacatcatgcaacataccatactgaattggacagtatggagcgtatcgtactgattcggtgccaagacatattaatgtgggtgaatggcctccttactagatgtaccgatgtgataacaagatggcaccgttaaccaagatggtatatcttagatcaaactattctctaatgaaagcattggaccttgtccattgcagtgccaccattatactacagcaagcttaaaagcactggtgctgattttaagcttgataataatataatagtggtagtgctattggcagggaaaattacaagtacttctacaattttagtacttaatcattgctgaagtaaattgtggaataaggcatgacattgttttggtaaaaaatgtaggattaaattggtttttttctttagaacgtgatcatttaataaattagagaagttggtagttagaccgcaaacatgatttgcttgtaaagcctgatatcgaatcctccttaggtttattcttgccttgttaatgtggacatacagatccagggggatggaatgtgagtttggcgtgatccaaatctaaaaattttaaattcttggagtagttggcatgtgacctgatcaacaattataccacgtttaggaacatgatagcgatctctctttgcatgactctgcttagtttttagttgcaactaaaacaatatcaaatgtgggatctctccttttgacgcataaacaaatctgcattggaaaatttttacgaaacggacttcctcggtagctggcgcagtacaccggaagtgcatcaccgacagcgggctggtacgatcccttgctaattgaggcaaggctgaggggagctttcttaggatatcttggtctgcccaaggatttggatctagtctaaatggaatgggatgaatgtgggatagagagtgtaaatagcctctacaaatttttttattaaaataattgcttgatagcatgacccacttgactactagtttgcatcaagcgaacatggaaaaatgctaaaataataaaaatattttataagtagaagaaaattgtgcaaatttaagctaatttgaaagggtcaataatatatattaaagcttaacactcctccctcagaagtcatatgtgtctcgaccaagcaccggatgaaaaataatgactaagatgagtcaagacattatcgagataattaaataataaatgattgaaatgcacccagataattaaataaatagttgagtatttattcaattcaacccaaaaattttaactactaaaaatgtcaacaatatataccataataattatgtacgatctataatgggaagcctgtttaccatgcctatttgaagtggcctgactagccaaaaaatcttactcaaatattatacaactatatgaaactttttaattacttggagggggcattttcaaatatttgagctctctgaacacatgagtcatattagatggattcttttgggttttttccttgatttctgcaatccttttcaccttcaatgataaattctttgaacactgagtgtatattgttatctcaagaaaaagtcatatcagatggatattctttccttcctttttttttgaaaaaaaaaaaaagaaaagatatctaatttcttcgccctttaccccaacgaatcccatatgatgcataatgtttacttggccttggatagtcgatagagtatcaacaaatgcacaaattttaagaaaaaccaactagaaaaattagggttcactgtaaagattagtcatgaaaatacttgcataatttgctctagaataattcttgttccagaatgatgatggtaagagcagtaccgttttgagtccgactaacgtaaagcctgttaatctgtcattatagttaaaagattttcacttcaattaatcctagctacaaaagtggaatttccacaaaatatagtatactaatttactttgcgtgaaaggtttcatttgaaagtttatggtaggctttcttccttcaagccagacactctgttgaaataattcccccttcgcttaccacggccaaccacatttgttagtacaagtttagaacgacgcacttgatctgttgcaaggtctagaaggaagtgaagtacatgatctactactaccaattacgatcagatcatgagattaggtgaatgagtgaattttagtcgctttcgctcatatgatgtgaaaggccaactatgatcagattatgaggttaggttgagtgaattttagctgctttcgctcatatgatgtgaaagtatgagatcagatggaacacatcaaagtccaaagcagtcaactgaacatttctaaaaagaaaaagaaacggtactagaataatggctgggaacaggggtaaactttatcagggtttgggtttaggtttaagtatgttgaagcagagaagcacattaaacatgaagatagtggtctctcagattgggttggatttttcttagttgtggttggatttttaatgctatctattacaatctcagcatcgtagaacaagtcagtttcgattccaaatgtgttatttcttagatttaggatctatttggatgttggagtctaaaatttcatagaattcattggttgggccagcataattagtaaaaatcagcctggataaggttgattaacaaatacccaagggttgagcctttatccttacgataggatttggaccggcccactctaaaggttcatcagtatttgtgaatacaagttaaccaggctgattttttctagttctgccaatctaactcatgaattcgttgagattttgagcccaaacatctaaataagtgcttattaggataaatttgctccattttgactggacatataaagagctagttggtggataaggatatgaatgggctggattaatgatgagcacatagtaatcctctgaaaggttgcttgtcaatgggctggactaagcaccaggcaaaattcctatcaaacatcttacgctagggacttggcttagctcgaggctagaaagcaatccagaccatagcttgaagtgaatttaggtcccatatttgtctgattggtatcaaatcaagcttaattcatgttgatccaaatcttaattttagctttcatttgatcaaatcggggagaaaaaaatcattcttgccattcattcggtatgtcgctccaaaaaaaaaaaaagataaatttttatgaaatcttgagagtatgtattgcccattttattttcttaaaatccgatttataaaactatagtacaagagctctattttcaactgagatttctctttacaaattttaattaaattcaagaatttttcagtaaacaaaattatcaaaacaatctagaaaaccagatctttactcttatatttttttttgtctttcatcatatagctaacttgtccgcgaatgatatatcttggtcaaatatcttgacaagacgtttcagagcctcaaatgacctcgaagtgcaatatcatggcctaatatacatacatgtgaagttgtcacagcatacatttcattaagacatccttttttcttttgggaaaaaacgaaaggatgccgatttattgtctccagattgcttgtctcacaaaataacttttgatgtggatcttgctttcagctctcaccgagacctatctaaccggtgtacttagaggattgccatcaagactctatcgggattccatgtgaatttcattttaatttcacccctaatttataatggactcataggttgaaattaccaaattacgaggagccgatattaatttatgtctgattgctctacatatagcccattgaactgtattttctaaatgaataagagtcgatccaaattgatcttgtaacaatatcttttacagaatgaatatatttttcaaataattcatatcatcaaatatatctattttaaattttattccaatcaaatgatctgcagcagtcaatatatctcatgataacaaaaatctatcattttaagatatatctggattcagtccccggtacatatcttgtcaaccaatccttcctaatttctcttaggttaattggatagcttggcaactgataaccgcaaattggaccagcctaatgatcgaaacaggaaaagactaaaataaggcttgaatagccctttggcccgccctttacattcatggttgtgtcgaagtcctggactccattaaactaaaaagttgttctattttttttttccaagcgccctgctctgtcctcggtttgagaccaaacaaaagatatattttattccacgcttataattgctaaataatatttaaactacacaatctcaaagtaagcagtttcttttagagtaacaacacactccatagatactaattaccttccacagccacaatggattcaaaagactagctattaactaaagcgcactgctttctaatttcccctgccttgcctgtgagcaccccaatctgtcccatcttcaccattgacacgccaaagtcgaagaagaaactagacttgggtgaatcgagccgagagtagacatagtctctcgtctccttgtcctgaaggagagcctcatcagagtggaacaacccccttcttctcacgactaacttgtagtacgtggtatcaaacgttgtggagctccctggaaccatttccaccgtcgtagtctcatccccgggcttacattggctccttagcttgatagcatacttcggatctaaagttgggtcggtgtcaccttttccagtgaagttgtagagtcgtctctcaaaggaataacaatgagaatttccaattgtgtgagctcctgaataaaaaattggccatgttatttgtcactaggaatattgcttctaatcatcatagtaacaatatttatcaaagttttcttttaccctctgtttttcaaaaacaatctagcacttcaattttagcgatattataagatgaatcaagttacaatctaatactgttaactaggcaatcgggtccacaagctttaactaataggaaaaagatcgataatgtacatcaggcttaccatctcctctcacgtgcgacctggattacacgtgtggagggacgacaatgaccggagccaatcaagataataaatacgttaattaaataaatacatgaagagatctccagcaaacctgagctcaggacatcatgtgcactaaccaattaatagggaaagcgtgaatgatacataacaggcttaacaaatgcaagagttatgtgatgcgaatattctctatgttatgttgatattacggtgtgtgatctaattttgtggtccatcctagaacttcctttgctgacacaaacaatacctgataaaattgccaagtcctttgcacttaaaccctttgcagcaaaggacgctttcagctgagtgatctcagcataaggagatggtaaattagccaaagcctcagaggccacggacacaagcccatccctcctccccgtggggacctcccaaaggttgttgctcgccatccaagacccttttccaactgaacgggtggcctgaaccagagcaaactatttctgtcaatataactagccctagaacatgcaaacaagcaatctgagaacaaaagaacagcttcaaatgtaccaaggagacagcatcccttgctgcgagagctacgatatcagcacatgagacaatccctggacatgctttctctaatgcttcctttgctgcatcaatgacataaaatccatccaggctttggttcggcattgcatccttctctgctaaattagtcttagtggagttcagtagtaccgagccatcgcaaccctgtggcaagtaaaaacacttgcaaacattatctcagtgcaaatatttagttaagaatggaagcatattaaaatctcattacccgaacaaagcaatcatggaaatggagccttaatagtgggccggagactgttgggtcctgagaaaagtaaccggccacggccttacgaactatagcctcagcgtatgggcatgagtttttgtagaagccaaccttcaaggcttgggcattggctgagtcaagaaggaagagcacggaggctaactcgaacaaagaccttaagaaaagcctcatggccgtctttcgcagtggtgacaaaagctttgagaacactggaacgtgagctgtggcttgaagccagtgaaccacctatttataagtgttggcgggctcgtggtctctagattgggatgttctttgacgtttctttaccacaccatttttcatgcgcattgctatgaaataaatatctatgatacgcaacaagaataaattaatacatcacacatcaccgcgtcaaggctagggtctccgcaccctgcccatcagccgccaactattagggcccacctaaacgtgtggagcaaggggctggggccgtggtgctataaacccttataatgtacgcactatcatgctaatgcatgtcatcaatcacggtggtattttgtgatccaacaaattagctggtgaatcagatccaccgtgagtctaggataaaatgaaattttttttttaaaatatatttatattaaacgattccatcctagattgatgatggatctaattgatccatctaatattttctcttgtgagccaattatcaagacatatacatgatgaatggaactcatacccgaatatctcgagtgttttagtgatagagagtgtgcaccatcatgtccgcggtgcatacaatgatttgtccatatggtggtacatgccgcatttggagtcattacatggaagccagctcatggagtcgaattttttttatgacaaggcgcgtggttgccacgcactggagtagaaaaatattttatgacaaaggcgcgtggctgccacacgcactggtgtttaatatgggcgattgcgtgtggttggtaaatggaacggccaatggcccgaggattgggtggcgtcaccccttacgtctttttaatattagtttagtgtttgagcgcgtggccggcacatggatttggacttttgcatgcgatggcgtgcgatgaccgttgtctgcatgacgttggtctacatggttgagtataaattagcccgaacgttttcatcagaaacggactccaagttcgaagaacaagagaataaagccaatttttgcagcattcaaagtacttggatgagctgtactcccagaatgtccatccatttgagaaaaaaaaagggtgagggaaagtcgaatgctttagaaagttaaagtaacaatgatattataatcactctgcgggcgagctaattaatttattggattaatgcctgcttcaaccttgccaagcatgtaccataatgtgatctgtagtttcttgtcactcaatggcaaaaatttccactaaatggactctcatctcggatctcagacttgttatatagtttttgatttttttactaataacttagctgctaagtaggctactgatggtacattgcgtagggttgcatatggaacgtgaatttctagcccagattcctttcaaatttagaacttcggtagtaggctttggatgtttgtcatcaggtcggggttaaagatggtccaatatggggctacatatgatgatgggctgcactttgacaattggctgtcaccgtgtcaaacaagcaacttgacgtctttgtacgcttttcacaaagtagaatctaaagcttgaagaaattgctccccagatggacctgaatcggatgttttaggacactacactttttatagttctagcatcaagcttttcctttcttttcccctccaaaatggtgtagtttggaaaagcctacattttgcatttatttagggtctatttgaagattgtgggactccatttcataaataggctacaagtggatggagtccaggctttactagatccgagcttaatgcaattgaaattttgatgcaacatctagatccaacttaatgtacttggaaattgtcttaacctgcattgagttgaccattctattttcaaaatttgatcaagaaaatagatcaggttaaattgggccatacctaaaccctactctgcatttcaggcttgagccaagattgtctttagagttaaggtaaatgtcaaggtaaaaaatattttgatatcaataaatatttgttagtttttattaagttttatgtggataccaaattatagttttgtgaagtttggtatgcaatcaattttttttgtgcgatggatcttgctcctacactatacccagtccttactcataatggttgaagtagtgcacatcgagttgaaaatccttttgaatcaactctaaattttcaggcttgagtcaaggtcacctatggagttaagataaatttcaaggtaaagaatcattggatatcaataaatacttgttagatttggttaaattttaaatggataacaaaataatatatgtgcgctatgaactagctagctatcctaacaaatccattaaaacacgtggcaattgtagctatcttagcttagcataactcattgatgtatagtctgactatctacatgtgtgtctatttaaactttttacttacattaatatgtctatttttgggccaggtttgatattcttgaaacttggacgtaccaaattcatgttatttcatgcaacatattaagtcagattggacaggggtctgctcaaaatcgaaaaatctaagcctaagtccaaacacaagtagtgtttagatttaaatggtatgacccaatattggttaggatcatatccggattttattagggccaacatctagctgcatttcaacaaaattcaagccattttgcagcctgttcttgaactttcatgcgtttggttccctgggatttttcaaagcactttagtgatgtacccaaaatatacaggcctttttccgcctagaagcaataatacatacgaacaatttaagcaacccttgcaaacgctaccttgatgtgatgctgatctgattctcctcgcctaggtgtgatggttaaagtacatcaaatcaggaatcttattaaatttgcggttctgccagacataaagccatatatcttaagggacagcgagagaggatgttgttattttaccacctgtattttggtccattcaataaaaaattatcacatcatctattattaaaaaaatatattattatttaaatttaatcaaaaattttaaataaaaaaaattttactattaattatgattgactggctaataacttttgctatttaaaaaaaaaattattttcttgaatattgtgatgactttttattgaatgatctaagatacatgcggtaaaatagttttaaccaataatttttcaaaccataaggtcatggtaacattaaaattttgtttgtcgtatctggttaggcctcacaactagtcggtcatgatgaaattagctaaggatatccgcgtgcgccacaaaactatcttgcaaagttttagccaaaaaactataataataataataataataataataataaaagctatcatgcaaacaactctgccttccatcctgatttgatggaaaaaccaaaatgttcgtttaaggtgttgattaactggtccataagaaaaccaggacctaaattttcattttgagttgtaaaagaataagactattcatataaaaattttcagggcagcctttctaagccaaactttgaatatgttaatcaacattgctaacattgattaattttgttaacttactctaattttggtgacacatcaattctgtaatcatgttaataaaatttaggttaatcatttgttatagcaacaaaatttgcagttagtacttatcttctagccaaggcatctgcttttgtttattttctttttttttaaactttttaattgctgttgctccgaagaaaagaagataaaatcagtcaagaatcgagctggagctctgtgagggatcaaattgatgaaatctgctgacaatcctacaaaaaaaattcctaaaactagtgggagatctttcgatttaggaatctcagatacttaagtcagttggagcctgagaacgaatagtggaaaagaaaaaagtagagagcaaaaaaaatagattggagtggagaaactcggattcttttcaacagagaaactaaaaagagttcattagagtcttagttttgtgagtcatgatttacctcccgaagagatccttgcccctccttatataaagaagctcgctaggtcattaggtcattgagagagtttgttagaccattagtaaccacctgcttcgaaagatcttatttattaaatagttatggataattgacctagtttgttaagagtttgttacaacaaaatagtcagttgtggagaggttgtcttatatggagaatagctataatatggttggaggatagctagcttgtagtacatctgatcatgagagagagatcggtggaaaatcgatgtttgcttaaaatgagctgactcatagatcggcaaacgtagcttcaagtcggtaatcatctgacctaatttagagtagtgctagtagtcattggatgattaactgatgtgatatgatgtttcagctgtagatcgataaaatatggatatcttttgatgctgccatatggttagaggtcagttagatacaccaacaattgtgaaatgattttgcattacttttaaaatagtttctgttatggaatataaattaactcatattgttaaaagttttttaaaaaaattataactgggatgagagaaaactgggcagaacttgggaaaggattattatataaaaaggagttgtagcttaatatatgcattagaaggatgagctgcatttgccaacaactgttctttcagcatcttggctgtctccatacgagagatctggcgtttgattgggacagtggcaaacaactaccatattgctactataaattacatattgcttatgtgtcttcgaaggctagtagtagatgcttcttgtttttttttttttttgaatagatcgtggtaggtacttgttaaaacgccgacatcaagaagaaattattagatggactatgtcatcatctggagttcggtttagatggtggcaaataaataccatattgcttatataaatttttaataaaagaactccttttatcttggcacagtgcttccgcgtcttggaaggctggtggcaggtacttgttaaaataggcatcaagaaaaaattattaagtggaccaatccagttgactagttcaattgtcggttgcgacattaccctccctcgcatttaaactattcaagatcaacatagagatgagaatccatcctatcattcagcatacatgtgcctcgatatctagactagtccattagatctggtccatataagaatttctcaacaccaagactattagcctatgctaccaatgaagaagcctcgttcttgacgctttggcgagaaaaggtcatagagtttaagcaaagttctgatccgatcagagaaaagaaaaatatctttcaacttgtttaactaaaatctctaaaagaccgaataagaggagaattcacaaaaatagagatcaagtcatttttctctctttttttttttattgataaaaaatatgatatataccctctatctatagtaacaagatccgtccatacacatattaggttttttagttctaaaaaaattcttttatctaaaatgaatatatttagtagaaataattttgaaaaaactgaaaccttttagaaagcatatcccgacttctatatcaactgtcttttatcattccatcatgattcattttttggattgaaagctatactcggttaaaatcatatgtgaaataaaaattttcaagttgaccgatctgtttcgaggctcaaaggaaagaatttcatcttgatcgctaggaacaccaccctctcacaccgtagatttcaaaaattatttttttttaaaaaaagatcattttaatcggacatcatattatcaagtcatcgcctcttaaaatttggcacgtgattcggcttcttgatgtgacggatcctgcttctaaattttgtccagctctatttataatgaccgacgtgatccatattgagttctcatagttgtaaaaatgatccacatcaaatctggtgatccttatggatagtagcagtggtcaaaatggtccacatattgagtttgatgatctatttagatcaattgctctcttttttttttttaattaataatgttcatgtcctcggaattcaaacaactctccttaatcatcttctgatgccgtattttagtatgttaacacaccccggacgttgctgcttcaattgtgctgacgacatgttcacgtctttggaattcaaacaactctccttaatcatctcctgataccgtattttagtatgttaacaaacgccggacgttggctgcttcaattgtgctgacgactccatgctttcttagaccaacttcagaaaatgcaacgcaaaagaaaatattgaagtggtttttttgttttctttcttgtctgcttatgttggagctgttaagactcaggagacacgggtatacaagagaataaattagatggacggcaacttgagcgttagaaggcagctggagatttttgattaaaagacttcaaacaatgcaatccagtaataggacgagcaaagtgtaaatcttaataatatcgattccattactgttcaagtaaatggatacacaaccaaccggaacaaattatcaaacagagcagaggattagagaaactctgccttattgcagccaattcctttcagcaaccttgggatccaaggggctgaactcgaattcctaagcttattaaaactaaacggcacaacgaaagtttctgacattttgatcacacctggtctagttaacaaaggcacatcttttccttatctcaccttggccgtgcgtgaggacttgaatccttcccattttaaccatggactcggcaaaatctttgaagaactcgtctggcgtcgccatgacctggcgttcgatgtatgctttagtctcagggttatcaaggagagtgtcgtcagatgtgaagagacctctccgtctggccacgcctttgtagtagcccaagtcaaagttgaaggcgctcccaggatccatttccacccgggttgtgttgtcattaggcttacattcgcacttcaactccggtacgtaggtcggatcgatcgtcgggtccaagtcgagatggccggtgaagttgtagaggcgatccgagaaggatgagcaaagtgaatgcccaatggtgtgcgcacctgattgcaataaagaaaccagaagttggaagttgttttggctatcaaccagtggagatgcctcctgagttttccataatttctgaactttatcaaatgtaaaagttataatttttaaagactagtgcatgcaaggttaaggcgtgtgttggattgcaccctcactccagagttttgctgggttttcatccattctagttctttggaaaaaaaaaaaaagaaaaagaaaaatgtagtatgaaaggtttagtttagataagtaggttggattttattttttcccctttttttcaagaaactgtgcttgaattatttataatcaacttgagatgcagcaccaacgtcgaatttacctgatagaactacaaggtccttggcagttaaacctttttggataaaggtggtagccagagtactgaagtttgcggttggtggctgcaggtttccctgggtatcgttggctactgatctgcttccatcccttcggccagtctctattgcatagtatggtccataggtctggaaaagaagatcactgagaatcaatcaagtgtcttagttatggttaaactattctactcataagaacataaatcttaccaaatgcaccgaatcccgagcgatcatagccaagatgtctgcacaggagacgattcctggacaagcgatctccaatttagccttgatgccatcaatcacatcgtaacctcggatgggtagatttggaggtgcatctttctcagcagggatgttatttgtagaattcagtaaaagggaggcatcacatcccttcacagagacgataatcttgttgtgaggagagatttatccaaaacaacatgcatgtcaaatgagatttaagttacttacatggacgaaacaatcatggtaatgcatccgcaggaacggtccggtaagaaatggtgcatttgctatgatcttggtcatttcttcgaaaactataaattctgcataggggcatgagtttttatagaacccatactccaattgtgctcccgtcgagcctatgagaaggagtgcgagggccaaaggaaccatgggcctaaagagagcaacgtaagacatcttttttgcagaccaaactatggaagaatcctctgtgtgcatggctgaatgcgaccggacatggtatctatttatagtcgagtctcaagcatcggaactgccgtggaaatggtgaaaacttctttaattaaacactaattaagtggtatcttgatttgttaaccaagtggggttgggctgggaacggttcgccttgagggaaaagggttgacttgtgacttggccatgctgcaagaagtagacatatggaatgcaatactttgaactactatatctcaatgagtaatatagaattacatcgaaaaaaaaagaatgatgtagaaggaacaactcatccaagtgttaatctatatgtgatgattgaatttgtaagatcaacaaccgcaaatcctcttaacataatagaactcgggggtggttacacctcccatttcatcaagaaaacaaaaaactgcaggtccatttgtggaggaaagatccagaattattgttaatgtattacacctcccatttcatccaaaaaacaaaaaaaaaaaaaatgaaagaaaactgcaagtccagttgtggaggaaagatgcagaattactgttaatgtatacaatggtcttcaaagtatcttaatattcacctaatattgatgccgaggatggtataaattcaggatatgcaatgccaataataataaatttgcatctttttcttgtttattttatagaggtaggtaagaagaaataatcctaacatgtgcttgaagaaagcgtcctatcagcattagatcccaaactgggaacacttaattagaacgcggtaactagagcggattctcccatcaccggctatctatattttttttctcctacctgtacgcagacagggactgtttttaaatttcgtgtttcattggtctcaacgacagctgggaagcactttttttcttcttgacgcaagctccttgtagcaccttctgaaacctccagctggacatttttttccattcaataaaggccaggtcgctgccttcccagcctcctttaaccataaaaaaaaaaaaggccctctaaatcgcatactattctgcagtgagtgagatggagactctacatatgtgctcttctagtggaggtcatttttttttttggtttagaactaagaagattcctagaagtcgactgttgctaactaggaccaccagaaatttcttgtgaccgtctattggttctaaaaactatgactggataaaaataagaggtttctgatgcagaccatctaccagtatcaagccaaaagtcaagttccaaaagagatttttttttttttcttttttttcaagtgaccacaatacagcattgcttttaatggtgacttgcaggtggtatgtctccatcattgactatgtctcttttttgagaaaataaggagaaaataagccacttcgcccaatttaattattacaccaaagaatggacgtaagaaagcttttaagctttttccttttttccttcaagagagaataggagactaatgagcttcagccacataagttacctgcaattttattaaaggggaaggaaaagtttatgtacatacaaggaagattgtagaaaagaatttacatctgaaacaatgcagaaagaagattcaaaaagggccaacataagccacttcccccaattttattaaaagcttttaagcttcccaaggaaagagcgatacgagcaactactaccaagcagcccgtgttttcagctttgcattgttgatatagttagatttcttctcaatcaacatgtcttagggccaattcaatgatcagatttaggctatacctttttttccaaagaaagaaattccgatatatttttgttgttacatacagatgattacataatttgtcaccaacatcatcatgcagttccaattcattaatatcagccttcatttttatcaacatgcatttctaattgtggtatcgtgttcagaaaggaaaaaaaaaattgatttcaaagccattaagcactcaaatgtcaattcgcgttagtttactttttcatacaacaatctttctatgttttgctgtttttttatttctttctagatacaataagactcgttctcaaccactgagttacaagctcattaatttagagctggcaatttattagtaagatgaccaattcacaaatatagttttcaaagataacattgtttatcttaactaacccattagacagctacaagaaacataaagatcagaatcacgaaacctccggtcaccctgtctgagtggttcttctcagtgctgatctagaaccatcaacgaccacctctaaccaagcaaatatagaataaatcaaattggagtgtgaataccttttttttgttctgagtttggttacatgctccatgaactcttaataaaatggactaaataataaagcccctttctttcctacagtctgatcaatggcatatacaagtacctaatcattaattctggttctaggtaggctagagaaaatattctgtgcttttctactctctacttctcttacattacttggtcctggtcatgcaagaatagtattatcatgtgtttatagtttgattgtgtctccaatgaccgaccatgtttggcaagccttttctttctgttgaggaacctattaccaatctgaaagcattgtcttcatcccctgtctgctttcttatcttctgttgtttttactgattatctgaacaactggatgtaatgttttgcatttcttcttcgtctgtatctcctcctctgtaaatagttcctgatttataataaaagccggatggctgctttcctagattcccttatcatcatcaaaaaaaaaaagtgtttgtagttcacatgtcaattgtagttccattcatcatattagttcaaatgtcaaatctgcttttcttcagagtcaacccataaaaaaatttgtcaattgtacttcaagataccagcaagtagaatttaagagtcttttagcttctagtcagctaataatcttggtgctatagaaattatttattgaaatatttggcctcagttgccttttagtttgctttgtttacaggtgtggtcgttagagaagctagacaagaagcacagccccatgttcttgatggtattataaatttgaaaaagtcctgttttgtgcacacagaatttgttgggcccatcaaagctggcttagcaacttgatattcaactaccctatgtgttgcattaatctatgtgatttaaagcaatcttcttatttcatgtggcaagagaacttttggttaaccattttcagaaccttggcatgccgaatacgtcatctcgagcagaaatttgaaaattattcttttttttttgggacagaaaatatggaactagttcaaactgatccaggacaaggctaattagaaaattagcatcattttggatgataatgcccaatttagaaaagagtggttagccccaggcccccaattaaaccatccttgcccaactctggtttgggcttgagttaattggaattaataaaaggcagcctgataagcccctcccttttacagaatgatgcctagacgaaacagaagaatcttggcttgctgaatacgtcgtctcgagcagaagtttggaaataattcttttttttttttttttgacagaaaaatggaactagttcaaactgatccaggataaggctaattagaaatatagcatcattttggatgataatgccaaannnnnnnnnnnnnnnnnnnnatccaggataaggctaattagaaatatagcatcattttggatgataatgccaaatttagaaaagagtgatcggccccagacccccaactgaaccagcctggcccaactctggtgtgggattgagttccttggaattaataaaaggtaggcctgataagccacgcccttttacagaatgatgcctagaggaaacagaagaatcttgcgtttttcctctatgctattttagctactatgtgactggatggtctttttcttttcttttgttgatgatgatgataagggaggtaacccccttctttattaaatgctaatgaagaagatgatgcaacagagataaaaaaaaaaagaaaagagcgcgctgatgccaaaagtaaaacacatcagacaaaagggaaaaagaagactatttggtactctgttttacagtcagaacacaaaccaacccacaagaagacaatagaaaaatcagacatccagtggctcgtccctcaagccaacccccatagcatcactgcatcaggctcaaagagcttagcaacacgagtttcagacatcagccatgagattggaaatgcacttgaccttgttccagatttaaccaaatgcggtcagaagcttgtgatcagcaatagtggaccaatccttgaagaggtgaagtcctttaacagcaacagaggcaactgatggtcgcttattgaggagaaaaggcctcctgttccttttccctgcaacaagtccaagccatcggcccgagcaacattaggatgagcggttgcgcttgcttgtaaaaatttctcaacctccagctacgacaaaggcattcaaacatggattacggatgtagaacgccaagagataagcatattgccttccaaattgttgagaagaaaacacatatagagatcaaaggcgaaaaaaaaaaaaaaaaagaggcaactgtgatctattgaccccgatagagaacacatcctccgattaagggtggcaatttatgacttttttttttttgggggggggggggtgtgtaaagagcagcactcttgattcattaaataaaaactcacaatcacaagttacataagttttgttccatatactaagatacaatagtagttgttgcggctaatctctccgtcatccgaccatcggaatcgcgcacctgcaagaaaagttctcactgataagagatgccttcggcagggaccctccgacggtcaagtcagagaggagactaggcaatagtgaaaaattagagactcagcgggagagagagagagctagagagttcaagagcttaaaggcgcttcagagagcttgagaaagcttatcaaaactgttgccttaccccgttttatagtagagtgcggtatagtcccaccattaatggtgcagacaattggagagttgtcaaatcgtcggaagctgtccaatcaccgtgggttgtcaagtcactggaattaatccatgttcttggcaggacaatgccccagagcgaccataccgcatgtccttgacaggacaactgcccatagcggttgtacagcgtttggcaggctggccgactatatgtcagtattcgactgtcgggacgtcgggtggtagctcggagacaccgtcggctgatctggtgccttgtgaaagtcggacgtcggccgccaccctcgacagtgagtcggtgatttgggttcggccggtcggaaacagtatggatctgttcggccggcataccttcggtcagatattgtcagcagccattgtcggagtcgttgtcagagtcatccgtcggttcggttggtagagtcgggcatcggtcggatcggtccgaggataaatcggcgtataggggtcagtcggtatatcccaacagtagtcaaaacagagctaatttagatacataatatagatcatctacaagaaactccatgcaaaacataagattgatttacacccattatgaaattcccctccttctagagcattcagttaaaaaaacaggtaaccagcatgtgatccttggtcatgagccacccttccacccgaagttcttgaacgagagcacctttcttaagacatattaggcaacctgtattagcctgcaagtagaatgataggaaatatagcagagagctatatgaaatgtagttacaaaaacctgctcaaattggaatgtctcccacatacaaaattggcgatcagactaatgcatgcttaggatacaagcgcatggcccttgttcagatactgcaagtctaacataatcacccagaaaggtagatgaaaccgataacaagttggatatgagctccataagccttggaaggatgtgggaaagtaaccgcagtaaacataaccaaacttttaatataaaccacagaaaggaccattttgagccccccttttggagccccaaattcaggatgccaaacaacaaccaccaaaagatattgagataaaaggcagcatacataatagtgaaactgcatggcatctgggcacagaaaaagatcaatgctttctaatgaatgccacccgagcacaactcaacctgtaacaaggcatttaggtctgaatgtagcatctcgcctctgtcaaaggagtagtcagcaactaatgcctcacaggccatgtaatcggctacctaattaccctcccggcaaatatggaagatcttaaccagtagccatgatgatagctaatacctgatgtcatagaaaaaagaagagtaagtatgagtagagccatgagaaggtaactaatgaatcattgttaagaagtccccttccaagcaaaaattatgacttaatgcattaatcttacctacaaacgactcactttcaacatatgcagatttgacacaaatgagctgggcccataaacgggttaatctgtctagatatgtttattaaatgggtcacattcgatttagatctttgatccatttaatcagttttcactcttttaataattggattaggtcatgatctatttaggacttatttaatcagtttaaaatctatttaatctatttactttcttgatctcatctgcttaacctgtttaatccatttagattcatttaatcttctaacaatctgcttaatctgtttaatatatagattataaaaaccgtatcaggttacttgtttaataaaccagttgggtttagattacttgtttaataaatgtatctgatttgggtcgatgaatttttgatccaatttatatccaacccaacacagcccaattgccaacacaaccatgaggggataattttgagcatacaaattatgtttcatctcataatgtccctcatctccacaccccacccccccaccccgccgtcctcctcctatctctctctagtctgtctccatctaacctttctattctctctctctctctctctctctctcttgctctccttcctgtctgcctctcccctctctcctgagctgtcattttctgtctagaaatatggagagacccacttaccttgccattgtaggacttctgtcaaacaaccgaagttgccaattgcgaacactatactaatatattgtcatttgcatcgccacaatcaccaatcctcgtaaccttttgtctcaatttgctagttaaatgttctaagttttttaccggttccctatcgcacaggtatcattttatgaaccattttatcagtcacgcatcctgaagttactagttttagatatgaagtttgctagtcatttccccgaagatacaaatcctaagtattagttctatgcctccattttaccaatctaaagtgcagactttaccggtctttttagcctaattttaccatttcaatcagcatgtgaagtttactagtcttgctacttttgaagatactaaatatgaattttgttactggtcctaaatatgaattttgttagtcctttgccccgaagctacaacccaaaaattattgagctcttgatagccacacagaaagactgatgagtggaggagggagacagaaacgggaaggaggggatgggcaaataggaaggagggagaaacgaagagacggagagagagagagagagagagagagattaagagagcgaggggaaggttaaagagtgaggcaggactcctccctatcaaccagttggcaaattagcttctctaagatagccaggggtcttcctccaaaggggtagaaatggattaggtcccgtcggatttggtcttcatctcgtttaatttttttttttttggtttgatggaaataggaggaagtgagaaatttttccaaaaattttaaaggagatggttggcggatcgagtgccgtgaatggactcgagatggtgaccaagatgagttggggctcttgcatttaagccactgcttcaccatccaatcgtagatgcacgactcacacatggtctgcactcaacccatttgggacacgaaatgataagctcgctttggtcgcgttgagacatacttattggaagaaacttgtcgactaaaacttaaccggtttattagaagggccagaaattcaaaacaaaactcatctctgcattaaacgagttaaccaacgtaacttgcataactcacttcataaagaagctatattggactacacctatgataacatattaaacaggtcttaaataatttaaatgagcctaaaaaatcttaaaaaaggtttataattgtgtcaacctgatctaatgagtctagacagattgtagctctctccagctatcctaagggatgaaataatctgaacttcaacaatttcggacttgtttgaatggctaggccgaaaatcttttgggtttcatggattaagcccatacaattagcagatctttttttttttataggatttggttagatccatccactccaaaactacttttgtatatttatatgtataaaattagctcaatttataattatatgattttgctgattgtactgatctaattcataaattatataagatttttagcctagtcatctaagtccttaggagggatggacttgcacccaaataatgttagtagaagaggcttctccaagacctatagctagcacaaatgattggattggaagtgatggaaagagttaaggaattcgaaatgaaatggatttattatagggaaccatgaattagaaatcatcaacaacttgaaattaatgtagctcaataaaattaatccatagtccattctttcaacaatttttatgcttaggttcctaaattagcatagcgttccactgcttctccaaccaagccccaagcctggagagaagggagacgaggccaactggccaaagactgaaactaggcagtctcccttccttatattcatccttatcttcccatattattagcaaacagtctgtttcatgacggatgtaagaagtgcgccttcttgctatctagctaacaaaattattgcctaattgggatacgattctgagaagaacaggagctgtacttcgaaccttttgtactatatactgttgcaagttatggtcgtcgtcatgttgtatattgtattgaaggtccatggtactacagcgtgccagaatggagcataatggttatactttatcttctaatcagctgattgttttatggtttttcttttttttttttttgaaaaaaaacggtcttctaagagccagccacatatttaacccataaccactccaccccaacccacctgggccaaagcccaggcccggtaaggacgtagtcaagcccgcgagaccagggcgctgtttaattgggttcgaagtgaaggccagcaccctgaagaatctaatccgtctctcccgtccaaagtggtaagaagtggtactatttcaacggacattccgtaatagcccgcaaccaagggtgcacaaaaaaaataaaataaaataaaataaacttaaaaataaaaaccccggccaaatcatgaatctgatccaaaccaatgtcttcaattcagtttctatcaatttttccttttttggtttgataatttagttttgtattgttttgagaaaatcttgaaccgaaaaaatttggttcgacttcaatttgagttttcgaaaaactgactcaaaccaatccaaccagactcaacttttctatttaaaccaacccgacccagcctatatgagtgtgtttatattaattttttatatttatgtatataaaactgaaaagcccagccaattttgcctactccatttcatatcaacatgtaaaatttttttgtttagacttcatccagcccatttagtacaatccattggacatcaatccaacaaaccaaaccaaaatgaatcaaatttctcaaattgatttcaagcaatttttgtagatggactgttcgatttgggtttctatttttttttcagaaaaaggtttaaaccgaattgtcttcagatttatgcctaaaccgatccaaccaaaccggtgcatgccccccacacacaacgcatttcattgagaaatgaaatgagaaggccagagggccagaggagaacaggcagagcctaaatctccagtagaaataacaatgactttttacataccagctcgctcacgattagactcctgggtgaccttctcatggacataaaaccaaaaataccaaccaaaagccctcaaaccatgcagctcaaaaccaaaagaaaacgttaaaaaactcacatagtatcaagaaaactgtatcccttcatccccagcagcgaaaagctagcaacacagaaacaacggtcccctccccttggaggtgggtgaggcgcagaaggggcagcacagcgacgtgggatgcaagcaagatcatcactggcatgctccccactctttccacgaagaaccagatcagcgccctgtccatccagagaagaagccaagggtttgcaaagcactctcctgctctccttgcgtaaaaattctggcatacactcaagttacatagccaagacagccaaagtgaagcaatcataatccatccgtctcttagccggcgccctttcctttgcaaggttcggcccacagagaccacagagccaggccaacccttcaactggaatttaaactattttttttgataaaccgggtaaaactaatccattctagcgtacatacatgatacatcctgtaaatcagaagacaatatattcaaaaattgagcagaaagatctgaactagatattaatctttcaaagagaacccaacagatctaacaaactgacattgaaggaacatgtgatcagctatctcgggatctcgccagcagaattttaaaagaagaaaaagggtcctccaagccacccccatttacttgaagtatcaactggtctagcagcttgttgcagaccactaaattcctgaatattttgaaccttcagaggagctggtctctgccatatgcttctcacagttgagaacagaagccccccgctattcagaaactgacaaaaacctagggacggaaaaatgaaggaaaagaaaacccccttggtgaaacaaataagcaaggatattcaagaactggagcaccgcaaaaagatcttgatgttgaggctgattttagaaatgcgttaacattggcttccaaaatggattgccgtctttgctcataaaactaagcaacccaagtatctggtttccaagcagcaacatatagacaagggtgcctctcagcaagcacagaatctccagcctgtttatcctttcagaacgtagcttccaaccttagctttaaactgcaagagaaactgggggccaccttaagtacacctttccaaaattagcaactctcggggagcaacagagtttgaaatctacttgtcagagccacttcccccaccaagttgaactcccttaggttcacgataccaagactctctaatctagcagacttgaccagcctgcagtagagcggacacccctgccaagagaaaacgtgatggcatatagcatcgataagccagataacaatcaggcatcaggaagaatgccatgaagtacatcaaaaaatactaagcaatggactgcaatagcattaaacgaccaccataaaataatgtgtcatttccaaccagaaagcctgtcgtccaccctctcaatcacctggtccctatcctcatgatgcagctgtttgtcgatcaatggaagcccaaaaaaaatttagagctagaaattgctgcttgcaattcagaagtctcgcaacccactgtcctcaaccatccctgcggccaaggaaaaccaactcaatcttgtgaaattcaccctgagcccagataggatccttttttctgatgggaccagataggccttcaaaacaatagagaacaaatttgggcttggacttcttgatacatgcgtacaatctaggtttgtgtcactgtttccagtaaagttacataaacaatttcagaaggctgaacaatgtgaggtcccaatcattagccaattaactaaaattgaaccaagttagattagtaattacaatacagagtaataacttatattgtaattgagtaaagtataaacaagtaatcaatgctcaacactttagaatctagatttagaggatttgcttgcttaaactatcatgctttagtttcttaactgtcatagcccaaaaccaagcccaagcccaactatctaagacccaagcccattcaaaaaaaaaaaaaaaacagaggaaaaatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatttctagctgcccgctaaatacagaaaatcaagttggccaaagaacttatgaaggacaacataagagtggtggacagatttctaaaacccagagaagagtttatgcgcttactcaacagaatgcacaggcttccaatacactggtgacaggtatgaaaaatttcgaggacgaaatttctttttaagggtgaagaatgtcatagcccaaaaccaagcctaagcccaactatctaagacccaagcccattcaaaaaaaaaaaataaaggaaaaatcgggaagaagactcccgataggagttttcttctccggcgagacccggacgagatcggaatcctaggacctctcggagtcctagggttctctataaaaggatttttccctcccttgaagccgatcatcggccttctttccctcttttcctctgattttttcgaattagagccgcggatccttgcttcattttcaccgtgattgctcgccggtagggtcatcgaaggtcgagatgagttccccttctttttctctcttccctccccttcctcccgtgcatttgtgcgcggctgccggcgacgggagtcgccgattttcggtcgaaaaaagggacctctgttttggtctctttttcccgtgaattttccggcgccggcgatcgcaatcgatcgccggccatgctcctctgtgaccggaggagtggccccccctctgccgccgacctccgccgaggtggccgtggcttgaacggcccggcacaaggagtggaccgccggtcccctgttcggcctggaaggagccgagagaagaaaaagaaaaaaagaaagaaaaagaaagaaaaaagaagaaaagaaaagaaaagaaaaagaaaaagaaagaaaaagaagaaaaagaaaagaaaaagaaaaaaagaaaaagaaaaaataataataataataatatatataaataaataaataaataaataaataaataacaaaaaaaatgagagagagtttctctctcttcttccttttctttcagtctgaacccttatttcctctctctagaattagactttttctctctactttctctctctaaaattttctttctctagattgtttctctctcttgatggatttttctctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgtgcgctggtatttgtggaccctgccagtaggggttgtgcgctggtattctgtggaccccatcaatgggggttaaacgttggtcataatcgaggctattgagttacgagtgttttgaatcgaatcgaatttatgattatattatgtgtgaatatttgaaaatattggatttgtattaaatcagcatgaaatatacttttatgtttatttgcaacattattcttgaaaattatataatatctgaaatatctagttgagatatttgttacttactgggctgtctagctcgttacctttctttctatttttcagattcagaaaattaatttcgagcgtgggaagaaatattgggacagagcttttagaggtgagatttagcattgtcaacttcaataaacttagatctattgttttatttttagcaaaaaatttattggatgtaagacatttgatttaattacttgaattacagttgaataataattatttgaatttattccgctgtgatgcattgatatcgtgatgagatgccttgcatgcttatagagagagttcttcatgagtatgcggcggttgtcgcgatcctcgattcacaatctcggatcgggggtgtgacattaatcttgcaccttctgccctttaaaggaggatattgagaaaatatttatgattctgttgccggttcctaagctaaatttcacataaagcctgcaaatagacataattattaaacaggaagaacgaagttacttttcagtggatggttattagaacccctcatccctatgacgggtagaaaatctctctttcaagtaaatctgtgaagagcttctacgtaacttatttgtgaaaatttagctatctaggaacatgaagtacaacatattttattgtgttatttatgtgcttgggaccatatacattagaacagctgtagcatcttgcattatcgatcctctgattactgcaacttattgaaaattataagaacaaacaagaagaagactactttacaaaattgaaataacatttattactacatgacatgaatgaatcactcaaaagaacaagaattactcatacacttgaaacgcccattgctacatgacttggttcctaaagaagcttaatgcaacaattccgataacctaacgatcttccatagatcaaataaccagcctagctatctagttaacaaaagcacaagtcttcctgatctcaccctgtgtgcctgtgagaactccaatgttacccatattgatcatggaatcaccaaaatctttgaagaactctgatgcaaaggcaccgctggcatggcgcaggacataggccctggtctggctgttttggagaagagctgcatcagacttgaagaggccccttctcttcgacacatgggtgtagtatccagtgtcaaatgttctgaagctacctggatccatctccacaagggtggtgttatcattgggtggacacttggccctcaactttggtatgtagttgctgtcaagattggggtctgtggagttgtatatgcggtttgaaaactgaacgcaatgcgaggtccccagtgtgtgcgcacctagttaggaatgaacccaagttagattaacagtagtcatgggttattcaagtttcatatctagtctaaaatgtttaattttgatggttaacaacatcaaagccttgccaattaaatgtagctttttttccatgctgtatttgattcagatacctgaagatggatttattttcagactagattgatgtactagctttggtcaatatagtgagggggaaaagctgcaatttaagtaaatcaaattttatgtacctgatagaactacaagatccttgacactgagacctttggattgaaaagatgaaatcaatgaagaaatggtggagtttggaggaggcagttggcgagtctcctgggcaattgatacgcggccatctcttcggcccgttggtaccggccagtacggacctttggtctggaagcagatgatttttgattaaaagaagcctttaatttatcaataaggtaagatatggagtatgatatgatacattggcatttctttttcctcaagcatttcttaccaagaacactgcatccctcgcaaccagcgcagtgatatcagcacaggagacagtctggggacaagctttctccaatctagccttgatacgatcaatgaccccgaaacctcgaagggttagattcgggggtgcatctttctcagctacattgttcttaccagtagaattcagcagaacggagccatcacatccctgcgtgtcaagcttttatattgagaacttctcttcttaattttatctcctaaatgatatgcaagaatgtgtgtcataataggcttagtaacatacccttacaaaacaatcatggaaatgcatccttagtagaggaccagcgagacttggagcaactgaaatgatctgagtcatctcctggcgaatgataagttctacatcaggacatgtcttgctgtagaacccaacctgcaggccttgcgccgctgctgtgcctaagaagagaagcataagagtcagagggagcaagaacatgaagtaggttttggaggccatcttagaaagcaaaggtgatggaactctcactctcggatgctgaagtatgggacctgatagcagtacttatatagtgcgtgatggtcaactgagagaacttgtactctgaaaggcttgtttcgtttgcaacttgatttgttccttcttcttaaaaaaaaatcgtttggtttgtcagtgtatgattttatatgggaagttcagttagagagaacatctgaagtcttagggcaaaagggttgacttggccacggtagaagggatgcgtaacatggttagtctcatgcttagcacaacctctcctcaaatttgaagtagacgtaggtagtattcattgcaccaccaatatttaaacattgttctcacctcaacacaactcatctatgcacgatgagagagagttgaccatgcgtttaaaagatgagttcacgttcttcactacgggagacacttcttcatttaaaaattacagatccaacaagcatcatcacccgttggtgcggtgatcgtgctggtttcataacataaaaatggatcaaatcgcgtagattaagcagcttatagttatcatgcatgtgtttgtgcttgatatttagttagaacggtcatcatctaaagtacaatgacaagggcgtgccactagttaagtcatttgatcttaatggataaactattgaaagctatcatgccagagaatatgtatatatattctctagtgtttagagcttgatccaacatttgattgagcagtttagtttagaagatagaatgttaggggcttggtagatggatattattaataaattgagcaatgagagcctgacttcctaattaagcaatgagagccttccttcctaatatttaacatcaagtagaagtaggaagtggtgaagaaacacaaaaatatgcttcaaaaaaaaaaagaaaagaaaaatctgaagtcattattaatttttttcattcaattggttgtggtggaatcaatctcagcttacccatcaaaaaagaagcaccaagtgtgagggtagcctgtcgtcttctttggaaagacgcacagatgagttaataggtttatatagctggagatggagcatagatgtgggtatattattggatcgtttattcttccaagctcatgatccactactatttttataatttggttgagttgtgcccagctccaccaaacgtatgttaggatgcgggttggcctcgcactttgtagcattaatccagcttcttttgggaaggtatgttcaacctagctagattgagttatacttcgtgaagcttatcagttagttacagcacattggagatcattatttagcagtgcattcacatgtcatcagtagatctcattgtaatctaaaatcaaggcatcgactatgagaataatctaacatgagagctattaatgatcaaccgaaccatccactctaaaatgcaacaaaaactttttttttttgactgattggaagcaagatgccaccctatttattgcatgaagaagaaaaatgcaacaaactcagagattagatatcatgctgcatgtgaggttaggttgagtcttcctttcatgctccaagaaccggtcaatcatttcaaggcataatatatagcttagttggctttgttggatccttcacgccacaactcagttttaattagttggcaaaatcccatctaagttgtgtcctgccttcaaatattgtagatccatgcttctaccaagtttctccaaaggagagctagtctatttggttaatattgtattttctttctttctttcttttttttttgattaaataggaagcaaaagatgccacttaatttttattaaggagtaaatacataaaagctttttacatgatagctgcttgcctaagcgatccgtagacagataaaaagaagatatccggaagaacagcaaaataaagggataatattttttccctatattttttttctgttaattcacatatctatcattgaagccccataatccagttgaggtagcaaaataaaacactttttgactgccttgcatgaacaatctcaaaaatattcttggacaagatacatgaaaccataccttccacgggtagaataatgataatttggatcaaatttatggatgattcgatttccataatgtatgaaataggttaaatctactgtatttcaatacataaagtcagcttctctacaggaaaaattgactcttaattgagcatgttaccactatgaacttccagtacatatagtattacctgtgcaagcaaattaagattcatatggcatattctcaaatggatattgtcggtcatggctagcacgattgcattccaataattaaaatacgattaacggtaagtaaaattatcatattcattactccaattggtaatacttaaagaattaattgctacatgcaaactgttgaagaaagaggtgggtggcatagttgttggcctttaaaactcaaaaaggcttgtatcaccaactcaaaatatatataacatcgtagatcagtagttgtccttcgagacaactgggaattagctgacttctcctcagcatttgtgcaagaagagcacctgtggttctctcccaaacgtttttggaaggacttcatagagccatctcatatgacgaagtgtctaaagagagatgcttcagcttctctagagtgcatcaaataattacttggacccggtccaatggaccatgccaaatcccacagcggacaaagcgccacgtaaccccttctatttcatcaattcccgattccacattatccaccctccatatgctctgatccacttggatctggtccatgcaataatttctcctggagtgtccctatcccccgggcacgcacgcgcacgcgcacgcgcaaaaaaaagggtgcttgtccgttcttttttaaaaagagaaaaataagatatattctattttttgaagaaaaatatatataattataataaaaaaaaattctcataaatttggtggaaatgcattcatccaagtttttgaataatgatatttttctagtgcataaacttggcatgcatgtgatttccggtgtaaatctctgaaagaggttgaggagatatattgggaagaaatttttcgataaatgaacagcgatcacgaggatgaatatcaagtttcgtgcagagcagcatttttttatttcatttctacaaatataatttatttttaattaatttatttgtctattctttttgtactaattataataataattttctaaactattaaaaaattctcaaatttttcacttcctttctctcagtcaaatgattctttgaattattgtccaaaaataaattaatttaaaaataattatacacaatttttatgatttattcgcaacaaagtttaagaaattttgttttataaataaatgatatcatatcttgttgctaagagtatcatttattaatattgcctctcttatatttatttttaaatatataaatttataaaattttagaaaatttatattttttatttttttaattcatggttattcaaactctttctaaaatttttcattaatttaatatgattttttcaaattcccaatcattaaaattgttctggaatgccagacttaaaactatgcgcgaccacctcatcaaaagagaaaaaaacggaaagctgggctagacttgtgctaggcttttgtgagtcgaataaactttggcccaggtccttttgtaggtttgcacgagaagtggcccattaacaatataatctggcttggttgataaaagaagtatagaaattctttgtgcacctcccgcggtgtaaaaaatctgacgtagagtgcaccacttcatcctattgaaccacgtagctactgctttctaacgcacatttaatatccataattttacattttcgtttgaaattttgaataacgaaaatgtcgttcttaaaaattatgatacctcttcttaaaaattatgacatatatttccttccaaaaaaattataacatcctatgttgatattatggtatcctgcattgaaattataactttctacacagcgtgtcataatttttatgaagggatatcataatttttttgaaagagaaaaaatgtcataatttttgtgaaaaaatatcataattttttaaaaaaatattataattttttaaaaaatattttattatttaatttttttaaaaaataaaattataaatattaaatatatattaaaaaataatgattatatggcgaggcagcacgctccatgtcagattttttaccccgcaaagaatttctcaaaaaaaaatacggaactctcaatacgaggattctgcaaattgtgtctccggtggctaggaaaaatccaaattagtttcaaagaatgaatacatactcatccaagaactctgacatcaacagaaacgagtgcaactttagttccgttggtatgtatgatccttgtcgcttcgggtgagaagtggagcttcgatttgctcattgcatctgttctcgttccaactcccaattacactaaactctggcccagcaagcatgctagactttatttattacaaaaaaaaaatactaggctttgtctagctgagatgtggtgtcaggtgtatataatagaaatgcaaatgaatcgaacaatttgcaaactattcgattcaattcaattattattgaattcaaatagcttgagtagttttttgaatcgagatcaaattacaaaatattcaatttgaaaactcatcagcctactcaattatatatatatttttaataatattatttttatttataatatatatattaatatatatatagtaaattaaggctcgatttcaaatttgaactcgagcttgagtatgattcggttgatctcgaattaagtttcgagtctgaatattttaagtcgagttaaactcgagcttccagctattcagttcgattgcacctattttttttacatgcggacggtaacaccactctgatgcgagagcaatccaaaaaatcagaatacaaaagtttttgcaggaccggcgggatactgtcatcctgtcgctagctcagtatccagagtgctccgttacaaaggatgcgacccagtttgccgcattgttcgcctctcgatagatatatcgtaccaccactcctgctggaagcgaagtgcataccgtccagatgtcagcaagaagtggatgagcttttagctatctcctgctatcacagatccatctaatgatggtagcagagtcactctcgatgaagattctctccgtccacagctcttacctggcaaagataatatccgcccaagcaacatgaaactcagcttccgaaactgaaggcttgaagagctggaaacctccagccgccaatagcttggcatctgggccccggatgacaactttgcaccacccctcccatcctgacattgccatcaaaattcatcttgacaaaccccgaaggaaggggctcttaggaaataaaaatgaccctctagatcgctgtaggggcaacaagggagtcctagagaatggggacatcaagggatggactagcagcattgaaatgactacacttcacagtcaagcagatcgttctctccaacactcggtgtgcaggaactacctcatcctcgaagtcaggttgtttctggaaagtcaaatctggtatgcgatgtagaccaacctgccccccaagtggaggtcgttctatcaacagtactccgatggatcatactcaagaaagacacaagccaatgatctccgatcgtctcctaaggctgactgcctgttctcctccaaatcagctcggccctcagacagtgcaagatggcgtgttcagtcgactcatcctccagcccacaaattggatatgaaacagacaacttcatgcctctatctttgagaatcatgtgtgtcagaagtcggtccgatgcaatcttccagagaaagagtctcactttgagatggatggatattctctaaatctaagcagcatcaattctcctaaccatcattggcctacacatcttagaaagatccctcaaaaaaaccttaggaacacaagatcggccccacaccctcagatcctggctgcggtgaacaaaaataggagtggcgaggatccgatcagcaagcagaccgccaaataatctagtgatctcttgtatttttccatctctaccattggcgttgagtagatcacagatatgtagatgatcatctatctcactactaatgtaggtcgaccatcgagaaagaggaagactggagatccaagtatcccggctcacaaccatcaaaatcctatctccaatcagccatctgacctgagccaaaacaacaagccggtgagcacaaatctccttccagaggaaagagcaaccatgggggtccttgatctgggactcctgactccacgccccatactgagccttcatcaccctcctccagaaatagtctggctggataaaaaatcgacagcatgtctgaaaatcatagccttcctcttgattaacagggactaatcctcagaccaacatccctcacaagctgacacaccatctcccaggacagtaagtggatcccacactcgacattcctcgagccccacagaaaattctgaagccgctgctccagccctctgaggcaggaactcaagacgattatattggccaagaggtatatcggaatggaactaagcatcgatctcacaagagtcatcctacctatcatggagagagcattgacttgccaaccctcgagtcgatcctgaacccactgctccaaagatctacaatcgatcctacggagatgtcgatcgatgataggaacatccagataggtcaagatctcgatcaatttcgaaatctccaatctctctcgaatcgtctacttcacctgggtcttcatcatgcgactgaatatgaccgcagacttctgcaagttcacaagctgacctaacatttgataataaacctcgataatagatgcaaaacacctcacgttccacatcgagacccatctaaaaagggggcagtcatctacaaagagatggtgcaagagcagcgcgccctaggggcgggccagtaggtctccaacaccgacctctgaaccgtagccttcagtgttcgagataaaacattaccagacaaaataaataaagggagaggaggcaaccttgacaaagcccaatagtcaagtgaaagaactccatcgggtgccattaattaggatagcaaagctaggaatgtctacacagttcatagtccagtcaatccatctatcctgaaaattaaactctcgaaggatccacctaagaaactgccaactcatccagtcatacgcttacttcatatccagcttgatcgccataaggctccacagacaggagcacactgcagatcatgcataaactcctgagcaagcaagatattatcggtgatgcaccggccactaacaaaagtaccctactctgggcaaatcaggcgaggtagaatcggcttcatatgatcgatcaagatcctgacatacatcttgtagagagtggtactaagactgatcgatctaaaataccttagagtcgatacatcataccacttcgggataaaagtgatcagcatcttcttccactcctccagaatacctctagattcaaaaaccatctataccacctcctctctgataatagaccaatactgatagaaaatgagtgggaaaaagccgtccaatcctggggccttatgcatcctgagagatcaaagagccttccgcacctcttcgatcgacaccggataggttagaacctcattctccaaatcagagacatgggttgtaggttgggacccctgaaagggtagatcactacccaaggacgccgtccaacgaaatttgaagaactaaagaatctgctccctaatctccttactatcatccatcactctgtcgttactctctctctcaactgcctgatatggttgacgaacctcctgatcatagtggactgataaaaaaatttgatgtttcaatcaccttccctgatccactgaaccctagacttctgcctccacatcatcttctactgatgcagcaaagagtggtgctttgaaaacttgtgacgaagctctctcaaatgaagctcttgaaggcccccctcctgatcctccttcagctacaatgctgcaatgtccgcctccatcccctcgagacacctgaagatattaccaacctcatacggctccatcatagaagcctgtgcctggctaactccaaccttcgaatcattcgataccttgtatctccatggaccgacatccttcatacctcccgcaccagatcccatgatctgggatagaaagttcaaaaattcttaaacctaaatagggccctgggtaagtgaagtccatccgtcgaaataagaatcagataatgatccgaagtaatcctcgaaaggtgcttaacctgatgtcccgagaaccactggatccactctgcagtgccaagcgctcgatcgatcctctcccagactcgagccatcccttgtcggttgttgcaccagttacatctgagacccaagtagccaaggttaatcagacccacattgctaatgaagtctctaaactctctagagtcaatactgtccccaaactatctgcctctcctcttctcatgggacctcacaatacaattgaaatccccaacgatgaggaaagacaaaccctgcaaagccatcctggagatctcggatcaaagcaccctccgctccctatactcagtgcttgcatagactctgaaaagcaaccaaagtccatcgatatggtccgaaatgactaagaccatctgctactcatatctatggaaggcatccatcctgatcgaaccacgataactcatccccaggatacccctagactgccctctggacttcactacgtatgtgctttatgccaccagaatccgacgtatagccctagccagactcgcccaaaagagacaagtctcaaataggacacagacatcagagccatgctattgtatcaaccgattgaaagttgatcgaaacgaggacttccccgccctctgagtgcttcagatcagcaacctcatgatgatgactcacagagagcagggcccacacctgtgccccctcatcttgagagcccatctttgtcccaatagctatcaaatccatcgacgacaagcacgccacaatctggtgacaacgacctcatgggtagggtctcggcaccctgctgacgcatccatgtgagcggggtccattcccttgagaggtgctaagttcctctctccatctcctgctcaaccccactctccaccactaggccccctgaagtagagtctccctctttcatctggatcaaagtctcctcctcctccctagaggtccttgccaagaagaaaaagaccctagggtcagcagtgccaactaccgtctccatgtgggtctccaaggaggccatagcatagccttttcccttcttcttccttgaggaatctttcttggacccctcaagacccaactccttgccgttgggcttgagagaagcccggcccgtatcaaaaatagaggatcaggcgcacttgggctgggttgagcccactcctacctttgtggcctgcccgccatcaacaaggcccacgccctcacatcggcccagcgccagcccgcatgcggccccaatcaaaagctcaaagcgattggcacttgggctcaagcctacaaaagccttcgcatgcatctctatagcctccacatcaaatccgatcattggatcagacttggacctgatcggagatcgccgccacatgattttggtgggctagatccaactgtcgaatccgaccaccgagttggcccaatccatatccccatcagctgcttcctttttgggttgacttgtcttcagatctagcccaatcaacccggccaccatcttcctcgagtcgccttgagtctctatctttggttgccaccgacggacagccaccatccacaaccccaggcgcagcccctccgtagcaagtcccccatccatcccctcggtctaggttcccgccgatgagatcccatcacctcccctagcccgacacacctcttttggtaggtggaaacggatgcaccgaaagcaaatcccctcgaggctctcgtagacaaacctctgttagaaaatatcgaccggccccttgacaagcacccccgacctcaatggccgagagagatcaaccttcatgcacgtctaggtgaagccaaggcattaaaactccgccatgcagtcgtctatcgcaatcaaatctccggctaggcacagcacctcccagattgccacctcctcccaaaattatgtcggagaccgcaaaagtcggacccaaaggagggccgttccaatcacaccctcttccagaaagaaccctgatcgccatagctccacagccaagacttgtccagcaaccatccatcgccatcggagaatcaagcccctctccccatcgtccttgaaccagaatagaaggaagcccttctccagtccgtatgccgctacatctcccttcagccctacccgcagtcgaaattctttagccaccagctctgatgccaccgatcggcccaagttcctcgcaaccactgttgtggccgcccagcactctgagctttcccttaggacctccttcaggggcgcggcgacctcggagaaccagtggatcaggtcattcacctccttcgtcgtcggctccggcaagatccataccgtctgcccttgcatagctctcctccaattcgtttccagccgatcacccgcttttgaggccgtagaatggtctctacacgccacacactccgactagacagatcgccaacaatcccatgaatcgagaccgaagcataaatctcaaagcatatctgtcagtatcaactcacaaccagttccatccaacgctgctatgtgagcaatgcaccaggtgcaagatagtggccctctagtgtataagacagtggcccttttccatcccctcttgaataggagaaattattgcacgcaccaggtgcaagtgaattaggacaaatcgctaagcatacacacggtggagagcacttaattgggaattagtgaaatacaaagggtagcgtggtgtgttacctgttgggggatacccgccgacttactgccggaaggcccgacttactgtcggagggcccgaccgcccgaccgactgacggatgccttcagcggttaactaccgaccagtacggcccatcgccagccgggggtatgtcgggagtaaccatcccgaccgactgaacccgggggtctgaggtccgacttacatgaagctcgccgaccgaccggaggaacccgacgccactctgctggctgccgacctagggtcggctgactcctccaaccgccgtacggccgccagacgttgtcagctctgacacggacatgcggcacagttacctaggggcattgtcccgtcgagagccgggtcaaccctggtgattagacggccacacggtgacatgacgctttcacggcggctctgacagcccacagtgagttgacagttcctcacttgtccgcgccattaatgacggcgccatacctagctccactatatatgccggggaaggcaacagtgcaagggatcgatccgcccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgagctgggctccgttctgtgggcttaccgaacgaccccccgcgtcccgatcggggagtcgccgttcagtttggcctacgggacagaagctatgatcccgctcgagattggcctgccatcttcaagggtcgagcagtaccacgagccggacaactccgaaagtcggaggaccgacctagaccttctccccgaactgcgagatgaggctcaaatccgaatggcctcataccgacagagggtcgcccggtactacaacgccaaggtcagaccaaagctcttcaggcctggcgacctagtcttgaggaaggcagaagtgtcgaagcccttggaccaagggaagctggctcccaactgggaaggaccctacaaggttgctgacacctacgggccgagagcctatcggctggagacccttgaggggaaacccattccccggacttggaacgccgacaacttgaagctgtattaccagtgaattctgtaattcaattgtcggaatacaagttcagtttgaaaaatcggagttctaactcttcaactactgatcggcgctcagccccgacgcatcgacgcggatctggcaccgacgacacatcggcccattacacggaccgatgcatctacaatgacgggagtcgatactccttcgacgactcgtcggaccctcacaagggccgacggactcctatgaacgggagttacactccttcgactttcggcaacacatccgcccctgacagaggccgatgcagctgttgcgacgggagttcatgttccctctacggtcgaattttcgggcagaatccatcggccgacaggtcgatcgggccccgaccgaaggaaggctaaaagcccacgcgactattgtcgcgacttccgaccgtgctactgtcggtcgagggatattcggcttaccaccgtctatcacacgacgtgacctttgtcgcatctacgacttgccgaccgaccaacagccggctgaacgacattcggcttaccaccggacatcagaaaacaccgaacccgacgcaggggtatgggaacccgacttactatcgtttcccccgcactgcgccggacgacgacttcgactgtcggaacccgacctaaagtcgggacacattttactctcgaggctgcacaagttgctgaagtctaccgacttacgcgagttagtgatttgactaagtcagcggctcatgttcgacattgcaaacatgttggcattacaaacaaggggagaaagtaaagggaagtttcattcaatacttaaagagattttatccatacataaaagaaagtctacaaacataaggccgaagcccgattgcgagtcgaagcagagcataagacaaaacaaaaccgactaatcgtcggagtcaacgtcctcgacaggacgacgatgcgagttggtcggcggttctgctccgacttcatccgtcggggccgaccgaccttcggcaactggctctgcaacgtcttcggcttccgccctggtagagagaccgtccgacgctggtccggccgcctcctccgcagctggggcctccgactatggcagaaccacaccgctgaggtcgagctcggggtacaagccccgaacggcttcccgggcatcctcgtacccaacttggtacgaaaggtagccgctctccaagagctcttcgcggtactcctccgagtcccggaagacctcgatcgcccgacccaaagcctcctttgccgactctgcctcggctttggcgacgtctgcgtcggcctgcgcggcggaacggccttcttcggccttggcgaggttcccgagacttgctcggagttgttcgcgctcggcctccagctctttgccgacactgtctcgctcgtgacggagccgacgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgccccccaacggtcgagatgcaggcacgaccgacgaaggcaccccagatttcgccgcgtggcatcatcagggccgttcggcggtccgacggttcgacgcaccacccttcagatcgcgccacgtcgcctccatccgctccaccgaacgcgagccaatggccgcacgccacgtggtgcgaaggggcgcggcgcttggtgttcccgacgggacgcgacgcttggtgttcccgagggggcggcgggaatgacggttccacttcccgatgggacatgacacctggcgccggttttatcgctgacaccagcggaacatccgacatgacggaacgtccggcgccaactcgacaactgacgctgacaggactagacgtctgacaccgactaggcaacggacgccagcaagcctcttggcatttatgaggcgcctgacaccgtatcaaccggcggtacggtcggatattcgcgtacgacaaatccactcccagtcgtccgggatcgctacccgaatggaagcatcggccagctcgccacccgacttaggagtggaggggggcaactgttgggggatacccgccgacttactgccggaaggcccgacttactgtcggagggcccgaccgcccgaccgactgacggatgccttcagcggttaactaccgaccagtacggcccatcgccagccgggggtatgtcgggcgtaaccatcccgaccgactgaacccgggggtctgaggcccgacttacatgaagctcgccgaccgaccggaggaacccgacgccactctgctggctgccgacctagggtcggctgactcctccaaccgccgtacggccgccagacgttgtcagctctgacacggacatgcggcacaattacctaggggcattgtcccgccgagagcctggtcaaccctggtgattagacggccacacggtgacatgacgctttcacggcggctctgacagcccacagtgagttgacagttcctcacttgtccgcgccattaatgacggcgccatacctagctccactatatatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggacgacgaggcgattggccgcaacattacccatcatgggatttgtcgcagtccaattgcacctgatccatggaatacagaggccttgaacacacacacacagagagagagagagacagaaagagagagagcaaattgttttgttttgttttgtttattcttttttttctttctttctttctttacatcgaggatgacagacccaacagattggctgttttttttaaaaaaaaaactatcataatttacctttatgttttctagaccttaataagttaaatattaatgaaatggcttaaattcacatgtctaatgaatgatttgtttgtctggcacagtagaaagcgccgactacgtccagaaaagtgtctaacgtgcagcctgcaacgtcaaaatagagccgttgggacaactaatataatgtagcatgtatcccaagtatcgtaagatttgatttaattgcatgaacaagttctaaattgatgcaaatgaagaacagtctacgcctcgtttaaaaggctagtttattggtacaagtcgtggcacacaaagtcttgccaatttgcgcttctggaggggcacaagattgctggtactaatcagctctgttttgactaataccttttttttttcttttttttctttttttttttgatgtaataagaggacaaccatctagattttattaatagagagaaggaaaaaaatgtacaaccagaggagtaaacatttgttttcccaaaaatcaaatagacttggagtggtcaaccaggaccctaagatacatacaaacaaaactgggatagtcaacttaatttgtaatttaactgtacacaactggaaacctcatataagggcacaagaaaggaaactttgtcgctgaaaatatgaagacaggacgaagctcgctgttctcaatagcatgacatagcttgctgtgcaattatagtctaaaataccaaaaacatcaactcccaaattacagaattacagtctctcaatggcactgcatcgtaacagatgaaacaaaagcctatgaacgcatggtacttcaaaaattcttaaaccggttgtcgctaaagcaaagattgtagattcctccatagctaagatgaaacaaaagcctatgaacgcatggtacttcaaaaattcttaaaccgatcgtcgctaaagctgtcacatcccgaacccaacatctgggtcggatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagggaccgtgaggtcccctcgttggttggccggcgacgaggctttgggccaggggagaaagggaagagggagaggaagaaggggaggggcttacctcgagctccaacagccgagaagaactccggcaatcttttttttccatctaagaacccgcggatcctcttgaaaaaatctctcaatttcttaaaaatctctctaaaaccaattgtagagacataaggaagggaaggagggttttataggggagattttctacctctgatcggactctaccggtccgatttcatcgtaaacggagaggaagaagactccgattaggagtcttcctcctcctctattttttttttttaattctgggttattacaaaagcagagattgtaaattcctccataccttttcatgaccatcttagctcataagagtgtataagtgaacccaatagtgatatgagtacaagatattttgcagagggatatatttaaaatagctttccttcaatgagatcctggagtttcgttcacgccaaatctcccaatagagtacaactattagttgatttgcagcttttcttctggatttgtcaaactttttccttctccggtcagtccacatggcatacaaagtttggggccatcctctcatattcaactaacttttaataacatccaaatagaacagataaatggacatttgaccaaaaaaaatgagagatactttccaagttggctccacaaaagggacaatcggaactacctaaccagcctttcttggccaatacctctttggtatagggccgattgtgaagggtgagccacaagaacactatcaccttctctggtattgtagctttctaaataactttatagtaaagacacagcaatccatcattatttatgaatttgtataataaattcgtagaaaataaaccattagaggtgagtgtccatgttgggacacctactattcatgaaggccgaacactgaccaaccatcctttgagcattttcaattgccttgattggagaagaataagaggacctcggggtttgatattctatatcataattttttttgaccattacaatgctatcgaacaattttaattgacagcttatatgtatagctcctcaagtagatcacctaatatagtagctccacaccaaacattctcccaaaatctaattcacgagccatctcccaatttgaaagagagataattccaaaaaattttgagttgcttactgaaatccttccaaactagagacatccctttgaaactccttttgactctcaaattttttcttaatatagtaagctttcttgatttgcttccatcaagagaattcgaaatctactgcgaatttgcaagcccattttactaacaatgatttatttgcttaatatttttgattcttaggcctttgatttttttttagatatatagacagaattctaattcactaagcaatgaaattcactaactttgtctgctccacaagaaggcatgttgcaattggtcaatcttcttgagcacccaacttggaagtttaaactcggacgtgtaatatgatggtaggacaatcattacagaattaatgaataactcatctatcttaagagagaaatttacctttcaagatagctaatcttgtacggagtttctccaataaatgcaaccaacgatacttcaggattttgactaatatcctatccgtttgcttgcacttataaaaatcaaatgaatcaaaatgcttgtgtaaaacgcgtttggtgatctgtttgctgctgtcgtgaccatcgaagtttaaggcaaagcctttgcatcatttccacgctttttttttttggtgggggtggggatgagaaaacgaggtttatttgttcccattcctcatcttttcacatgggaaaggaaaggaaaccttacgtagaaagccaactccgctgtgctttgaaatttcaagattggtgtgaaagagaaattgaacaagataaacaaaatattaaaacttctttaaaaatcctctnnnnnnnnnnnnnnnnnnnntatatatatatatatatatatatatatataaaaatattagattgattccgatgcttaaattagaaaagactatgaaagagcaaaaagatagtaagaaagttaaagaaagctgggtatcatacattgggcttttttttttcgatgaacagttctttttcagatggattcgaactctagagtccttgttttacaaggaaaacatctggactttcctggtcagcctaaaagtttgctttcaaataaaactccaaggagaaattctttgtacaccgcctgttatgtggaaaatccgatgtggagtgcaatgctttctccaattggatcatatagccactgcttcctgatgtacatttaatatctataggttaatgttttcgtttaaaaattttgtgtgacgaaaatatctttcatgatttcttgatatcttatatgacttcctataaatatatatgattttgtatgaatatatataacttcctgttatatgacttcgtatgaatatatatgacttcttgtcatatgacttcatgtgaatatatgactttctgttaatatatatgactttctgtgaagatatatgacttcacagaaagtcatatatattcacagaaaatcatatatgttcacagaaaattacatgaagttatatatattcacagaacgtcgtatataattataggaagtcactcaaaagaggctttttacgaaggaaagtcataattttggatagggatatttttgttatatatttttaaacaaaaatatcaatctgcaggcattaaatatgcatcgaaaagtgatgactacgtgatccaatctaaggaagtgatgcactccatctccatatcaaattttctacatcgcagtgcacaaagaattactcaaactccaagtctccgtgccatatgccacttcctcatcggttgacatattttagttacatcggattccccgaccctcagctttctaatcgatcgaagatctagaaatttttttttaaaaaaaaaatttagcgatgaaagcgattggaagatctataatgaataaccacaaaacgacgtgcaagaaaatgctgtctccaaagtgcaccagcaggcaaagccttggtcacatctcatgcaacaacggctcccatccaaaaaaaacaaaacatctattgcaataacaatactcaaagcacccagtccccactcacccaatccacagttccacaccctttcacttcacgcagcccattgcctggtcatttggtcatcctctcggtggcctgcagctgttatccaaggcaacatgggaggatgtctaagcctgcatgtggtgtagaacgtggaaaaggagcaaagttttaagcatgcccaaaactttcaaaaaacaaattaaaaaaaaaatcctaaagtgtaagataatacaagactaaggccatacaagcactaattaaaattcttctgacaagttagtctatgtgctacagctatgatattaagccgatggatttcgcatacgccggctacaaggtacctagaagaaatatagtttattttggatagatcaccctctcttgacctcaaaaaaatttacctcttccaatgttatatcttatataatatgagcttcattagtttagttaatgtaccagttacactatctaatatgttaattttgtgcgaccattaactatataattattataattggtgagggaacctgttggatgtgcagtgaaattatctgtcgcttgtaccatatataatggtgcgtgggaataagttggcaggacagagaaaattgtgcaaagatactttggctcacacagtccctaaaaaattaggatcgtggaaatcacctctcaaaatgatccagtatctttaatttttaggacgaggatggcatgatctttaatacaactagtctgtgtcggagcaattagtgaattcataaaagggcaagccagattcgctaataccttggggataattttaatgcaactaagaataaggctaatcagtagtaacccgaagggttgtttgcagcttatcttttcggaattagctaggacaaggacaacataattgaggcggaaagatcaagattttggtgataaagttgctggaataaagagagaggatcactgtggacaatgttccagaattactgataaaaatatatggtaagaccatccaagtcaggactttctatcgctttctatcaccttttgagctagatagaacagctttgatttcatgaagattgaacagggagtcaagggaggcaaatttgacttcaaaaaaatgacagtttttaggggtagatgcaaatctgtggcacaagcgattcatgaaagtggtcaaggaatggggctctgtatcttcttgatttagattgtttatattgattgttttagaagatttcattctctttagtcttcttctaattttcttctcaaaaaaaacaaaaagaaggaaaaatttggtagtctgctgctcctttgaaggtcaagttcttctgctggtttgtccttcatgataaaatccttattgctgaaaactgggctatgtgcaactggcctcctgaaggctattgtatgtaatgtgaatctacatttatattggtgaagcatatattattggagtgccattttccaagacaatatttatggatattagcctatgaatgcttgggcacttctaatcatcacaaatcctcctcctcgttcacaagaatcttagacatggatggattctgcctactttggctttgtggtggaggatgtgtcatggaaaaaactttgagaatttttcactttaattataggcagccttgtgttatcatcttgaagtaactcccttttgtacatgctggttcactggtggattgacatgttggttctggcacaaaataatggcatggtggcagcagcctaggtcattactaaatcaactccaggccagctaagttcattgtgcctgtctttttttcttttttcttcgatggtataactgtttactgttcatgaacatgtttggtagatgactcggggggcattatctcatcacggggtctgcctttcctttgacccttttgcatctccctctttcctttgtattcatttctctcacgaaattaatttgtggggcagccatatttattttcaaaatagagtaccatctatctgtatccaatgaagattttcaaatgaaagaggtttcgactgtcatcgtgggtgacggacattgacatgaatgagattttgagctatatatctcatttaaaaggggctattaaggtccctgttggactaactaccttttaacttttaattctgttcattgaaaatttttccccaccttttgattttgattggatgccaatttgtgtttagtccccagtccaaatactaatctcatatatagactgaaatttaaagttctagttatgtacacgcggactggaatatctcgatcaaacaaaatttttttttgatatatccgaatttttggcgatgtgtgtggaccaagatatcaatatgtgaatcggtgtagttaaatcaaaattatctactctttcttttcttttcttttctttttttttttggatttaagtgggaggatgggaccacacgtttatttatttaagaaacagattgtacaagacctaagaggagccctacagagaaaaattatctactctttcaaaatattaattttaatatatatcaacttaggattagattgaaatatctatgatgactttatctcaacgaaatatactatttatctaataaatatatccttttcagaagtcaggatttgttgtacatgtgagctcaggagtcaataaattcttgggtttgttgagctggctagcaaacttcaaaatcaaccttttacgagtagaacagatcatctagaagactaaaccggctcctctggtgggtagtgcttccaactcagcatcaggtttttatcttttcacccaggtgccattcattgtgaagttgttccctaactctactcattttagctgttgctactctgtcgttaactgtatctggtcttgatttagctgctgttctcttcttcttattctactagtcttaaaccttccttaacatcttattctactcgaatttatgaacggatatcagaatctagctaagatttcgaatttatgaaaggatatccgaatctaagggatctctatttatatgcaaaattttgggtccacgattacattaaccgtcaggattaaagaaacttgtttgaaggaaagaaattaagaaccaagaggttaatgaaccggccataattacaaccttcgttcttatccccatctctgttagtttctcattttgttcctctcctatttgggattttttttatcccttttatcaaaaaaaagtcggcttccgtttctattttccatacttcctcttcccttttttctttttttttttggtaaggtactccctcttcctttttctccgctcttcttctaagcatgtttgttattatttcaccggtaaacaaaggcttggtcactaaattgttccttgaaatttagactaaaagttaattggatccctgacctttgaaaatttacactaccatccttggcattacaaacccgattcatttaagtcattatcatcaattttccattgctaatcaaatagaactatacagatgactttttttttgagataaaattataaaaatatcccctcaactttagctcaatttcatttacaccttatactttaaaatctttctatttatcaatatgttctaatatgattcagctattcattttatcaataaatggtgttaaatttttttctcaatggatgaaaatgcctcttgttcatgggtagattcgaaggagaaaaaacatgagaagaaaaaatagatgaagaggaaggagatgagagaagaatggtcacggataaggaatggattagaagaggatgacaagaaggagaagaggatagaaaagaagaagagaggaagaataggttattgacaggaaggagtggagatagaaggggccgtcgtaaaagagatagcttatgagtagtttggaggaaaaagaagatgagaaggtgaaattgataaggaagaaggaaaaaaggtggagggtgctgcattggaggaaaaaatgagtaagaaaaaagagagggagaaggatttttttgttggtgagaagggaccgatgtagagagggccatctaaagagatatgactcatgagttggtttgaaggagaaagaagatgagaagaaagagaatgagaagaaaaaagaggaggaaagaggggctgccggcaaggaataagatggaggaggagaaagggaaggagaaaaagatggagaggaagaagatagagaagacaagaaaggataaagatgaagaagaccgctgtagagagatatggtttataaatggcttggggaaaaaggatgaggagaagtggatggaaagaaaaaggaggagaaaggagaggagaagaatgggtgagaaagaaggagaggaggagaaaggaaaggaggaaggaagaaagagaaagaggaatgctgtccatggaggaggagattaatcggagaggagagagaagagaagagatggatattttttattattttaaaaaattttaataatgaagatagacggctggattatattggaatatattgataattagaaggatcagtttgatactttttaaaatacaagaggtacaagtaaaattgagctaaaattgaggtgatatttttatattttttttttaatgatgtgacaaaaagaggctgctcacaggactaagacatggcaaaaaatgatggctagaaggaaaatttgccatgttagtgaattattggaaaaaaattctcatcaaaataagagagaagctagggagctctagtttgactgagaataaagtaaattgattcaaaaaatgataaaactctaaaatttgaaaagcttctttatttccattgcttttagcatcaaaaaggataagtgaaaagatgggtgattaactcctagccgaaatactgtagaactttcatgctatgtttagccacatcctcttctactgttgttcttactaaagcaagcttaacatcatgctattcgttgctaaataaactcatgcagccatgggtttgatgtaaaaaatagaagagacaagatgaataagagaccactgacttactttacaagtactttcatttcagcaatatatttattgctcatctcatcaatggatgcatatatcttctttcattattaagaagcagcatcaacaatatttgtattgtagtatcatataaagaacatagtaagacaaatgagaagatgaatccatgaaagcaaaaaataaataaaaaagactactagaacgaatcattattggagcaaaaatttcatgtgatgatgttttgatgccaaaatgttggaaccatcctttgactcttgctctatctacttagaaaattcttctcacttttttttagcttaaaaactctaatccatagttgtccaaaattgctttgctatcctgagcagtatcttctagtctaaagagtctcacatccacctgcaagccaaatgatcttatgatatcactaaaaatcataaccaaaaaaccaaaataagatgataaaatatcaagacacaccaactcttttattaatgcatgtgattgaacactacattgatagtgcccactaaatatttatcttctgtggatctagattgctcctgcttatagtgttctacacttaaaaatgatctatcaagccaaatctacagtactgaatcataaattattataaaatatatgccttatatactttttgagacttgataatattctccacctgagcatcatatatcaaaattgagccattctgaaattcttttattttctttcttatcctatcaaacaatccaagaataaatttggacattgcccatgtttgattcgaactaactcgaaacttctgcacaatttaacattagccaaatttgatgaacaattgagctagtctcataatattgctatgtagagaaaaaaataaattactaacattccaaaattcctaaatgaaatgcacaatctctctatagtgatttgataatgtcctttgatactctgctctctcttaaataaagtccttatcttctttatgtttttttctctgcaaaatagaacttcaatcttttttgttttgatagaaattttttctccaacaaccgataatttttctttccaatcatctctctctactacatttagattctgtaagtggtctctatttaccgcatcataaaaaatatatcacctgtataattttatttgactagtgatggaaaagtagcagtaatggctaaaatgaattggatttgtaacgtccgagatggtactgtaatttttaaaaaattaaaaatttaaataatttttaacctaaattttggaggctaatttaataattaagctataaataaataatcagtaaaaatttcacacggggaaaaagacaaattatcgatggattttttttcgttagacgccggcaatgggtttgcaaggtccacaacaaacgaggatggaagtttcttaccaaaaaaaaaatcgaggacggaagtcgtaagaaagtgatcagccacctctcaatcaaaaaaaaaaagcatccatagtagaattcccattctgccccattatttctttcgatccttccctccggcttttatatctggaagcgttgcgccgcgatggagggtcccttcactggtggtgcggcccgggagggtgttatcccccatatatcaaaaagcgccttgtccctctctctttcaaactttccatgagggattctgttcttctcataaaaacgagagaggaagagaaaacaaatacaaccgcttctttcaccaggaaaacgcaaaccgcttgcttcttttctcccgccttctaattttcttcctgaaaaatttccccttggactaacccaatactacctctttagccaaatccagtgacgttcgcgcacaagaaagaagaattcatggcggaaatcccaaaaccggtgagtctcttcatgattcttttctttaacgttcagcgttaggggtttcttctatctgattaggtggattaagaagctcttttcttgatttttgtttggtttttcagtattctggagaagcgaaaccaagtgcttctgcgatgagtttagcccatcaggaaggcgatcgaaacaagacggaggcatcggacggctccgtcgcgatcgatatcggtgccctctcaagtctctccaccagcaacgaaaaggactccatttccagtcctcgagtctccgtaaattttcccctctcgtaactcgctttgcgtttctcttggatcgtgcctttagcaaatatttatttatactagtttggtatataatgtatccgaatttaccaaaaaaacgaagcaaatactttttattgcactctttttatttattgattggttgctttttgggggagttaaatttagaggttgaaaagcctttcccgaaaaggatctcagcgaagtggcggaagcgaggagcggaaggcggccgaaggagagaccgccgactcctccctcggtgagtccccccgcccccgattccgattcgtcaccgactcgtccgagtcaaccgttacggcgtgtcgtaacgacggaaatgacgtttcgatgatgtcaatccacgaaaccgtaattttgtctcgtctcgcgaggagaatcgaccatatggatggacctgattgaacatgtgggataatgttcgtgtgcaggtgggcccggatcggacgtgaaatcggctcttttggtgcacgtggcgggcgatggggagccctcggccttctgtcatgcgacgacgccaacagcggctggagggaggtgcaggaggctggggaggcggcaaacgccgtggcttgactcgaggcgggttctattcttcttcgccaccttgtaagtttccttcctgactaaaacgccctctatatatatatatttttttaactacaattacgagaacaaggaggttgtggacgggcacgcgcgaccaatgatctgggcgttaaatttgcttaaaaacgttgtatgattgggcgtgggcggaggaccaccgatggagtccatcgatcacacggctttcgatggtgatcggtggtgggcccaacgggaggcccgtgacggtggggcctacaagtatttgcttacgggccacgtctaaaacgagtaagggagcggttttagagacgttgaagccactggaccaaacggcacgctatggtacgggatagggccctctctggggtccatcatgtccatcaactgcgagcccgatcgatgggtcagtgtgtgagttgggcctgggaccaagtgacatctttagatttgaaaatgagtagaaaactcaaaaattatcggggtggcaatcggtgacgccggcctgcatctgcatgtggatcaggtcaaacatccatcacccccgacctgatctgtctactgaatagaccaaaaattcaaatttaaactcagtttattcattaaatagataatttgaacaatccatataattcactcactaaaaaaatcgagttaaattaaatggattaaatagattaagttaatttttcatggattcaatggatataaatagattaaacaaattaagccgatcaagttaaataggatcaaaataagtcaaaaattcaaatctgaacttgatccattccaaatcagttgatccatttataaccctaatctatctatgttaagcctgaatctgcttaatagatcgtttgtggtctagttgatgggttggactctaaattgcttctaataaatgatgttccactttttggcgctgcagacttgcaagaaattgaaatcaacatatgtgacgcatacatggagaacaaatataagatcactaggacaccatatgggtagcgtccgagagagcaccaaacttgactcgagggtagtttgggaataaaaagaaaatgtgagagggtcctagcgggatcccatgatctttgaatgctaacattacccagaaatggagaacataaagtacatgcgtgataaagtagatcatagagaaaatgtcatcatacatagaacattaaaaaaaggtaaaggatggggtgaagtgcaatctacgaacaagtgacactttctacggtaattgttacaaggatgttatcatgacataaaataaaagtgcatttgattatatttttttgatttttaatttttaattgtaaaaattatttttattttttaatttttattattgaataaaaataaaaagtatatttgataactacattgctataaagtaaaaaacaacatttggagatggcaaatgaagagtcgacgaggaaaaagagtttggaaagggagggagaaaagggtggagaggtgaagaactcgacgagggaaaagggttcaagctctttattttttggtttggcgttttagacgtggggaagcaaaaaaaaatagaaaaataaatttagaaaagtaaaaaaattttgctttatatatgaagtaattattttgattattttgatttttactttttatctttcatgatatcactaaacattattttttgatttttattttttaaaatcaaaaatatatatatatatatttttttaatggctaatcaaatgcaccctaaatgtataaataaccctcaagcttcttttcttttgtatgtgggtgatttgtcctttcacaaaattaatagtttttagtttgttaagcttgctattatagcaacattccactttatgattgtttgttgatggctttgtgttatctttcgggaaggtaacattgcatcaagtggtcatcctgatagtaaatgatttaggcaatctttttcatatgtattacacaatcagacacaggctaagaatatataaagatatatcatatatgatcaaattaactctttaaccctgaaaagagtgaggcttgagactctttttggctttttgtcactacttgtacacgtctaaaatttataatgcagaatatatttgtaagagcaggactctggatattcatcaacatcctccgatgactcctccaaaccccatccctattataccaatctcatttaatccaaattaatttgtgttcctataatctcacccttcctccttttcacttaaacatttgcgagtctacagagaaagtatgcttttaacattagcaaccatggggatgctacaatgacaagctttgtgggaagaaaagaaaaattcttttagaatccctcttttctataaggaagacttttctttctttttttcttagaggggcaactttgagaattgttttttgtttttcctcaagaaaaagaagaaaaggagaatcgtgttctgttgaagtttgccatgatagcaatttttccaatttttttcatcaattgatgccatcatgtcaccttttaggttagctaacacttcttaggtggagatgctgatagtatgatagcagtttctttaaatctaagtattgaaagtttctcacgatttagattcgtgactaaattaataggccaaacaacttctaggtaagattttatctttttattcaaaaccagcctcttgaagatggctcatattttttagatccaagttgcgtcagaacctagacttctgactcgataatttcatatgttatgttgacatcaacatgatgtttatctagcactgttgcccttgaagaagattcctttgctcgagtaggccttatcatgaataattatttgttaattatatggttgtgtatattgttacggctctattgacctcatgcgatttggaggccattggagccagcgggctatatggaagctgttgtttccacaagaaatggttcgaaaaatttaaatcttgaaattttattaaaaaaataagattacataattatttaattaaaagaagttaaattttatttgtcactgtacccatctcatcccatctagatcatagcctcaggtacaccaagtcaaagctcataaaatcaaataaaatctccacccttttattaagggagagaccaagcaaatgcttggtgatatctttctaatataaaatttggagattatagagttcaacaatggtttagtgatgttatgagtcaccgaaactttattttgtatgccaacctatgtgcttggccctcactcaattcatttctaaatcatgctagattccttgtgaaaggtctcctatccccaatttgcacgtatcagctcatcagtaagttattgttccatggacaggctgtatgtattgttagtgcgaatactttttcatatgaatctattattggatcgtgcaatgattactacaggcaacatcgcaaaaaaaaaatcaatcattcatttgcatgaaatatacaatccgaacctaggagggagatagataatggaatgcatgccttgcctgtgacaactgtaaaataaaaatagcatagatgttttagctaatgttaaaaatcaccagaaggaacttggagtgatacttatattgtccttcggttgcaggtctagcatgggaacactgatactgctatatttcacactctccatgaagaagatggccggtagcaacgccaacgcgcggtgatgcgacccccactgctacacagtgttccacccactgctcagcaataatattttcttttcagcatgcttggaactgtgtcatcgcactctagagctacaatggagtttcgaaagagtttgtatataagatgaacccaaaaaagagaaagtgtagaagaggtattgcagggctgacgaggaaaaagtatactttggtgagagtgttagaaagagacaccatgagaaagagatatgtaggtggaaaggagatagagagagggagatgtgtgtcggcatgttgttgatagcacattcctcttgttaactctggcccgaccaaggtgttccttctttagtttggtttatggtagattggcttgatgcaactccaccacttcttgcttgtgataaatagtcttggggattatatggtgagggcttagatcatttggggccatcgtataacagtgctatttgttcctgcttgcttgataggctagtggcttttgagacaaaaaggccgataaagaaataattttaaaaaaagaggggtgcaggtaaacataaagaaatgaataaatgaaaagcaaatttcgttgcagggtattgtgttcagcagtggcttacgcataggtacgagctggcccagaaaaggttctgccaagcttcaatactcttatacataacactaactagatgtttatgagatataatgtatagaaataaatgaaaaacaaaaaaatccacagacattgagtgagttaaactgaggatctcttaattgatagccttaagctctatgaaccatcaattcgccttcactgaattcaaataaaacagcaagtcccataactatcaataagccaaccaacttgcaaattaaataatcacaaaattaatgagattatagagagagcatataatacgtgatctctttggtctttttgtaaattaaacataagctcattcacagtatatttttttaatgttctattttgcaagaaaaaagtttttaaagaaagtagaccaataaattcatgatatcaaggaataatcaacctccacatctagagcgcatacctttccaaatctattgaaaactttgacatacaattcaatggacgcatgcttacaagacctataaatatctgcacactcattctagtatcgtttggaaatgcgtggcattaagcacttctgcttcctgtcatggtatatccttgcaacaactgctgcagtttcttctattgctttcccagttacctctgcattaagaaaaccaacagagtaagccaccaacccacattagtttcagtaatcgtttggaaagcctacttaccaatgactggccacactgggttttgcatgaaaattctattagcatattccaactcccccctcacatggtccatctctgagtagttgctccgcatttcactatcaaaccctagactcttggcccttgccttcctaatggactgcagaacaactggatttattgtcaaaccaaacaccttctcctgattgatttcaaataacgtcttgggcaactccacacccatgacaataggaacatttgccaccttatatcccttttgagctaaatatattgacaagggcgtctttccagtgcgcgaaacaccaacaaggatgatgtgtgcacgattaaggttttgaggttgtgctccatcatcctgtttgatggtgaaatcaatggcttcaatacgtctgaagtactcttcagttagtggagcctttcggcctggcgcacctcgggggatcccagagggtggaacaccaagatgggcagcaatagcctcagttgtcggtcgtagtatgtctgcggatgggacaccccagagattgcaggcatgttctgcagactcagccattgaaggatctgcaagggtgtagagaagcagtgcaccttcttttgcagcttgctttatgacctccatcagtctttccatatcctcaacctaaagaatatcagcaacatgaaactgtcaaattaagttgactgtgatcggacatgcttattgcttgaaaataaaattacagtgtatggaggatcaaaactacaggtaaagaggaggaaaaaaaaaatctgaaaccatgcttgatgctttgcttcttaagccttctcttgatgtcaatatttgcctctattttcattgccaaaatacaggatataaattggtcctttgagatacagtccacatgacataagcattatactctaaatatctgttcagataatttctcagggcatacaatgcgaagggaaacattatgtgttttaacaattcagcattcagtgcatcctcgtttgaagtatttgtattccatcctctaagcatatcaattttttttatgtctggcataactcattggttcagatgaaaatcccacagacctttcaaaaactatagcaatttaatcttagatattctctattccatttagaagcttgccaatgagggtgcatccaatgcttgtatgttgccggtcactttaatgtgcggcagatggataaaacagtaattggtaaaactactatgaacctaaaagctatattaaacacaatgaaaagagtccacaacaaaaatggtaatgttttatgtcagcaatttaaaaaaaaaaaaacacttgtagctaggagtcactttgataagctattcacataaagagattaactacagcacaatcaccttgcactgtaatattcaaggaatctttgcctcaggtatatgagccattgaaatccaccattaagcaaacaatagaatcagctgattatacttttaattacgaagcccactgatttaattatcctcaagaataatgttgacaagactgaacttctgctcttaaccaaaaaaattatgaaaatatatacagtgaattacttctgcagttttgtatacttcaaagttaaccagtatagcctaatacaattgtttccttaacctggaataagtaggtgatgtctgaaaattaaacaaactaatgcaatcaagtctgtcactccagtgccgttttgtcttcccctcagagctcaaagatatggttttggatgtgatgaactgctaattcaaagggtatcgcattagatagacttggaaaacaaattattcattgatttatctgggcaaggatgttgcagctgtgatcactagccttctggttctgctttgcatcatgctccatatcacattatttttaccaataatcaccgcaagaacaagatccccatgaaaaatgatgaaaccgacttgtgtccctaataataagtcatcgacaagtgaccttggagataagcttgattgcatcatggcaatccccacacactcggaggttcttagcaatccttatgggtacagctggtggaacttttagcaaactaaaagcaatagcaagtctctcactgtgggtacaaaggaacttcttcttatcatcctcccccacatcaagcaacacatattttttagacggcacatatcctgccttcactattcgatcacttaactcttccaacatttcataaatcttgtcagactctgagtgtgttctatcatgtgccccaaacacataaaccttgtcctttatttcaacccaactacacccagattccttaaataaacccttcacaatcatcaattttctcactcgtccaacatcatcccatctcccaactgaggcatatatattagataaaataacataattagaagcatttcttggttcaagttcaaaaagcttttgtgctaatctctcaccaagctctacattatgatacacctgacaagctccaagcaatgatccatatacactactgcttggtcctatatccatcctttctatgaacttttcggcatcatctagtcttcctgccctccccagcatatccacaacacaggcacaatgttcaaccccgggctgaatgccaaatgtctccttcatagtctcaaaaatttccaagccatcatcaacaaacccaccatggctgcatgctgacaggatcacaaccaaggtgatataggttggcttcaatccttgctcctgcatcaccttgaacaaattcagggccacattgaatcttccattcaaagcaaacccttcaatcattgaagtccaggttatgacattccgtctctccatgccactgaaaaccttataagcaaaatctggatccccacatcgagaatacatggtaagaagagcagaacctacaattacatttgaaacaaacccatttctgatggcatacgcatggattgcttgtccttttctcaaagaagaaaagaaacaacaaccaggcaacaatgacacaacagtaagttcattgggtttgaggcaccaatcaaattgcattctagagaataatgccatcgactcggcatggttctcaacatgagagcacgcatggatcatcgaagaccacgaaacaacatctcgaaactccattctatcaaacacttttcgtgccccataaacatttccaaatgacccataagcatggacaagagaattagcaactgacaaacagagaccaaccccatacttcactgtcagtgaatgcaactgaacaatcaaactaactaaacccaactcggcagaggccttcaacaatgccgagaaggtgtatgaatcgggattcaccccaagcttgagcatttcataaaaaaactcaagagcttcacccggcatcccattcttaacatatccagaaacaattgcagtccaaacaaatacgtccaaattccttttgggcattctatcaaatagctcccgggcacgatcgattcgaccacagacagagtacactttaatgagtttcggcagtaagtctcggtttctctcgaacccagcttcccgaatttgcaagtggagcctcttgccttcgtcgaaagaaggggcgtcgatgcaggattggagaagaacgctgaattcggcagacgtaatgggtgggcaattcttgtgacgagcattacgggaattagcattcagatgggagtgaggagatatcgaagagcaaaatgaaaccacgctcggattaagcgcttggctaataactaaatatcctcccattgggggaaaaagaagaggaaattgaaaaggagaggttttctttggtcttagtagcctactgacgccattacgctgttagatatgaccccacggttaccgttattgaccattaaaaatttatcataagttcatctttttatccgatattttaaagtacataaataaattataataaacattataattaataaaaaaatatattaaatatggatgataaactaacgtgttaaactctggagtcataacggagcgttacactggccgtcaaggggataaggatgaggtaaggtaggaagacaaacatacccctgagaagaggtgggtattcacggggcagatccggtcaacgaggcagttctcgaactgccccaacgccgcgttgacggagtgctccgccgtccaccccgtgccgtcggacaccatatagatgggcttcgccgcagccatcacgccgtcgtcctggaaagcgtccgagatggactgtgggttctcgtccaactgattcaaggaagaggtggaagaggaggaaggaggaggaggaggagagggaaaggaaggagcggtcatcttccggaaggtgggcccgtcgagccgccggcccgaccggattgcccgggccctggaccagcggttcagttgcgaactccccttgggcggcttacggaccggaggctccgggccgtggtcggcagtccggctcggaatgtcctcggggaggcaggcggacaaggggaggaaccttctggccggaaggagtttggggaatagaaagactttggaaaccaataattcttccatttcttttctgttaatttgaacttcttatcttttttattatatattgccttggagattcacgcggccacatcgtttcgtattaatatctgaagaaatgttatccacgcacaaaaataataacggaaactagcttataacccgtggcagatgcgtttttttttttgaaaaaaatattttattttattaatttatttatatatattttatatatattttaaaataattaaaataataaaaaatatattttatacataatacggattatgagttattttaaaataattaatttttttttaaatttattaaatttattttttctaattttattttttttttcggatcttcatttttttcaaacaataggtgttatttttaatttttaaaaaataatatttttatatattattattgaaaaattagagatagccaaattcaactgatttattttggactcattcagatttacatctgtctatttttatttttttatttatttaaaaaaatatatccactatgatcgatttatttacttaatcaccatatgtacataatttttttatataaaataagtctaaattttaaataaaatattattgatatttcatgaatatgaaaatgaaactagtaatgtaacataatattcatcatattaatatattaattttaattattattataaaatatcataatatgtttatctataactctaccaaatttaataagttcataatcttttctggttcaatattaatattttttggttctaacttctaacctaataatgttggttttaaaaaaaataaataatgacatttaatgctaataagtaggagtaaatgctaactctttatcaaaggcatgtgtgtatatgcatgcatgctatcttgaacttttttcatctaaaatttttttccatacaattaaatactatatatgtggtagatggagagacttcacctactttcttttttaggaagttcttcagtaattggttgtagaaaaaaaatatattattatttataattttaacattaatggaatagtatttaagctgatattatttttatttctattttatatttctatatacagctaataaatgaggagcatgctatattagaaaaccaaaagaaaactgccaaactaccatgataatttacaaaaataattttatcaaaaactatcatggttataagtacttactttttttgaaaaaattatgtatgctagtgaaagcatagtctatacagattgcaaaaggagagctcatcaatacaaagcctaaaagcctttattttaatatacatatatattagatttatctcatattcttaaaatgaatatttttataattagaaaatggatagatttgtgatttcaagcttttcaaacttttgaaataaaaattaattttatatctatgtggatcaaggttaagtttatattaaagtactaaacatcattattaagaatgatggtcccataatccaagcataataattttaaaaggaaagcgacaattgatgctctcaatttatcaaaaattgatttaattagaatcttaataatcaataattaataaaagatctgagaatatgaaggttaagagagatggttggattagtcaaaaaaacaatgcaagaataacataagcaatggacctagttttgaaggatgacattaatgaaaaagcattaatggaataatacttaagttgatattaattaaagctcctaaaactcttgctctcttcccatggtagcattcgttctattttgttttgctagcttttcgcctccgaagctcgctctctcttcttccattccactgccatgataaaagctccaaaggctctcgaagagtcgagacctcatccagatcgagcatatcagcacccactcgtatatctatagtctagatcttgactccactctggagacttgcactgtctccaagggcataattggccaacagtctactcgcaagatcgctaatctcgtcctccagctcatctgtgagggcaagatcattgtcgctaatctcttctctctcgagatgtctaagactaaggccctcacctagactttccacctactttgctctttgtctatagagctcgctctctattctccctttccactatcatgatggagctcaagaagctctcaaatagttgaaacctcatttaaatcgaacgtatcaatacccactcgtacatttgcggcttgagctttgacttcgctccggaggcctatgccgtctctaagggcatggtcggctagtaatccgtctacaagactgcttgcctcattcgtgagggtaagatcgtcgaccgcaccatccttcttgccagttagcccagcaccaacaagactgccattgctatgggtctcgtcaagtctcttggccaggagaccctcttcaccatcatttcggactcaaagctctttttcttcgagatgtccaagatcgaggtcttcatctagactttctattgtgccatcgacgtccgcatcaaaaagaagaggaggccgagatagatacatatgtcaaatggaggctctgctaatgcagaagcctccatttatatatatatatatatatatatatatatatatatatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttattacagttttagaaaaacctgatagttattcatacctacttggatttgaatataaaattcatatttaaacaaaaggatgccagccggcggagctatgtaggtaagttcttgtggattggatacaaccatccttaacctcggtccgacttcttctagttctacatctaaaaaaaaatttaataaaaagggactgcactgatattttatattgtttgattcaaagggtaatggcttctgagcaagttttacagtgatggataatctaaataaataaatgttatcttacatggaatacggattttttttttttccaaatgggacagggatttaccatttacaactttcgagagagagaacgtgtgatgtgtgctctgaggatgcaataagtttctaatataatgaattaacattttcttctaatagactaatacccaatagatgcccttctaatatgccgcaacaacataaaagaagacatcaagtttaggggtttcttaatctttatcttcaaacacctttgattgttaattcacctccaccaaatccacacaaaatagcaaattctagcttgaaacccctttgattgctaattcacctccaccaaatccatacaatatggctaatcttatatctaggaagaagtcaactacaatgtaaacttttagtcatgttatgatgatattaataaagagcgagcataacagaatgtgaccaatgcttttataaataaaacacttcctcatatatattgttttcataacatttttaatagcaaaattggaaaaaaaaaaaaagagggtaaaacaacatatccatgagatcaaggaaaactcagcctccacttcacggcacatatctttccaaagcttttgaagctttgacatacaacccaatggaggcatacatatttacagggcctacaaatatttacagacttcattctagtattgtttggaaatgcatggcaatgcacatttttgcttcctgtcatggtacatcctcaccacaattgctgcagtttcttcaattgctcgtccagttatatctgcaattagaagagaacaaccgtcaaaacaattgaaaaattaaccgaccatatcaacccacattagttctaaccaatgagaaatttacttaccaattactggccactctgggttttgcatgaaaattctatttgcatactccaactccttcctcacatggtccatctctgaataattgttcctcatttcgctttcaagttttagactcttagtcctggcattcctaatagactgcagaacagctggattgatcgtcaatccaaacaccttctcctgatcgatttcaaaaagggtctttggcaactccgaaccaatcaccatgggaacatttgccaccttgtagcccttttgagctaaatatatcgacaagggtgttttcccagtgcgtgaaacaccaacaagaacaatttgtgcacggttaaggttttgaggccgtgccccatcatcttgtttgatggtgaaagcaacggcctcattacgccgtaagaactcttcagttatcggagattttcgacctggagcacctcgggggatcccagagggggcaacaccaaaatgagaagcaatagcctcagtggttggtcgtagtatgtcagtggatggtacaccccagattttgcaagcctgctctacagccttggccgccaaaggatctgctaaggtgtagagtagcagtgcaccttctgtaccagcttgctttatgatctccatcagtctatccatatcttgaacctgaaaaggatccgccaatgaaatcatccaaagaagttgattgtggtctaacacgcttcttcattggaaattaaattccaaaatggatggacaaaagcagaaaaaggaaaatctgaaacaatgcatgatgttttggttcctaagccttctcttaatatcgagatttgtcgctttctctgtcttattgcaaaaaatataagatgcaaattggctatatcatgttgagttaacatgaccagaacattagaattaaaatatctccttggataattgttctgaaacacccttcatacttcgtgacaaactacagtttgaaatgttgcagtacatggatgtaggagtccagtacatgccattaccatagtacaccttcatatttatttatttttttccattttccagacacagtatatttactcatgatttgcagtatgtatcagcataccatggtaaaatgcagtgtacaccatggtatgactggttttttcaaacacaaataacattagcagagtggaaacagctcaatagatcttcagtacttctattctatcctcttaagcatattaatttttttcatgtccattataactgattggctcaattgaaaattacagaccttctgaaaaaaactatagcaattgagtcctatccaggtgttcttaatttccttttggaagaagccttgccaaaaagtatgcatcctaaatttgtgcaatccccgcaaattttgttggaggcagaagcacaaaatactcatgtaggtgcaggaaaactaaaaatctatgacaaaaacgaaaaaaatactttcattcctaagattatgagaccagtacaaaacagagtcttccatcatacataataatgtcagttacagcctttcagaagaaacgaaagaccataatagcagaacattcccttgacaacaacaaaaaattggtgcaaataaatagttacaggaaaaccaccttctcttgaaaatcctgtaggattcatagattaggctagcccgatcataggctacatgccgggttagacatgtattcataaaatactcagaaataacttggaagtggcccacccgaatcctacaggatcattagttggacctgatctacagtagaccatagattatttaatccttttacttccattttccctcccgaacacacgtcttatcacgcatttaatacctttcccctccttaacaacacgcgttaccgtgtttttaatcccatttccctagtcctaagtatcaaatctcaatggtccactttagaccaggtccaatcaataatttctcatcccataggaagaaaaaaacctcagaatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttttttttttttgttttttttttgggatttaggccaacccactccaaagttattcctaaacattttgtctggtccagtctagcacgtgatcttgcaaattataccggtccaatccataaatcatataggattctcagcccaatcctgtaggaaaattcatatttctcctcacgtacactgagccatagagatccactattcaattgacaatggagccaactgttcagaattttaatttaaaagccctttgatttaagtatcctttagaaagatgataacaagtcctaaaatttgctcttaaccaagacattctaaaattagcacaccggaaacttattcaatataacgtaaatatgccagtcaaactaattacactaccaaaataagcggctacgagactggtagcgatgtcgtttgatttgtgacaagcataaaataaacggattctataacggccgttaaggggataagaacgagaaagataagaagaacatacccctgaaaagaggtgagtatttacggggcggcgccggttgtggaggcaatattcgaactgccctaacgctgcgctgacggagtgctccgccgtccagccggtgccgtcggagaccatgtagatggccttccccgccgcgagctcgccgctatcctcgaaatcgtccgagatggagggtgggatctcgtccacgttagacgaggaaagggacgaggaggaaggggaagcgccgaccttcttccggaaggccgaccaacgtagcggccggcccgagcggatggaccgggccatggaccagcggttcagcttggagctttccttgggcatctcacagaccggagggtcgggggtccgttcgagcaatgctcggactcggaggggcaggcggagaaagggttggccttccggcgggagtaagtctcgagaaaggacaaggaatcggaggaggaaacaacaggccgtctttatcctgggggccagggaattcagggggctacgattttccaagataggagaaatatcttctttcacgcgaagatagcaggagatcgtttatttttttatagccttttacccacttgctgcggtcaaaaaaatccgactcttatttatctaatctaatatattatatatatatatatatatatatacataactgaggctgtacgttggcagaggctgagttcgacacgtttaaaacaattaagttgcaatatgcaacgctcccgccgtcacgcatgcgaatgggattaaatttcaaacagatggagggcattttttagcatatccgaatgtcgttaattcgatacaggtgaagggcctttttgtagtttaagaaaaagaaaagcgtgctccaataacgagcgcaattctgtggtttatttatcagcagtgcacgcatgccgttacggggatggcaattgggttggattaaattatatcgtatcgaatcatatatcaatcaatatgaattagatataaaattatcaacttaaatatgatatatttatcaaatagatcaaaaatttaaattcaaattcaatctatttattaaatagataattcgatccgatctatttaatcaatttattaaatagatcaaattagattaaacatattaaataaattaaatggattaaatatgttaaatatgttggattaaatagatcagaaataggttaagtaagttttaaatacatcttaaacagattaaatatattaaacagatcgaattaaatgaatcaaaaatagattaaataggttttaaacagattaaacaagttaaatgggttaaatggattatctggctcaattcgatctgaatattaaatggattaaaaagaacaaatatctaaaattcaaattcgatccaaatattaaatacgttgatctatttatgatccaaatccatttagtttagaccctaatccattgagtctaaatctaaatctgtttatgacggatcgaatatgagtcggattgacagatcagatcatattttatcagccatatgccacactcccacagcattccatcccatactaattaaaaaagttttctaaaccaataaaataaaaaaatctaatgataattattaatttcattaatatttcatggaatgtacatttacattgagtttaaagagaagatcaaactcggagaggggtggaacttctggatgatccaagagaatttcttcttgaattttttgataaaaatacttattaataaaataaattaaataataataataatagttagatatggaacgatagtgtgagtaccattgttttaaatagcaacaatgactattgaaattgtggaacaaaatgaaaatgttttaatccatctagcatggtatgcataagtcattctcttaccggataaaaaacatgttctcttgtgatgtacacctatcattgagagtggtatgaaattcaattgatcttttcataagtagcaccagatgcaaacgtaattttttatgatttgacaattcacattgctagattgcatagcttcaaagaatggtgcatggatggcaggttttgaaggttatattttaatttataattaaaattaataatatttctataaaaatagtaaaattaataatattaattatattgatagtatttttaataaaaaataatatattttagaaacaataattagaatatttttagaagattgatgatatttcatttttttatattaataaaatatatattattttaaaataactatgtaattaagaaactaattttttaagaatgatcgttaccgcagctctataggcggacgcattctaggtgcgcagcggcaccccaccggtccagagcacagatctcgtgcacaaatctggaaaacctttttcaactccatttcttgaccggaaaaagaaaactaagataatttaagaaaatgataggagaacgaagggcgcccgtggggaagtgaaagggagggccatggcctcgcggggctcctccttggcatggctgttaattctaatttagatttctttcgtttttctttgtaaatatctgaaattatatatatgagcagaatcatcgctctctagactgagaataagggaatcatcattccaaaagaaatttattttcatcctttaattaatgtaatactaaatacttgaatgatattaaagtttagatcctcattccatttcaatgttcatttcaataagctgagcataacgctagtttttttcttctctagtgagcataacgctagtttttttcttctctagtgagtttaataagatatttaaaatttgtgcttaggatccaggcaaagtaaaaattgatccaacttgatcagcctagactagataagatttcgaataatttattattatattgtataccatatagataatggatcattggatttaggctttaattagtatattttatttattttctgaatcaattaaatattaaaatagttgtaaatgtaggtcaaattactcaggatatatttcaagtttaaatcgagtttgattcaagcttgaattgatttcagcttatcttaggaccatcaagctgttcggttaaacatgttttcagctcaattcaaaattgatctcaaattcagatccaagtagttgtaaagaaacccagcttggtctcaaaattcaagctcaaaattcatttgaaagcattgataagatccaagtttgatcattctcagtttggttacacttcttgttgaggttacgtgcccagcagtacggaccttcctccctccaccaaacacgtgaggtattgtccgctctcggacagcgtgtgcccgcaataaggaaccacaatcgctgcccctcacggttttgccccggacgagttcctacagacggcgcaaatgttgagattacgtgcccagcagtacggaccttccctcctccaccaaacacgtgaggtattgtccactctgggacagcgtgtgcccgcaacagggaaccacaatcactgcctctcatgattttgccccgcaaaaggcgcctcacgtgggcaaagggaagcccgcactacataagcagtaaactctcttgattgtatccggtatgagattttcgagctcgatactcctgatgcccactccacaacactcctcaatgatgctactcaattcgatttcatcttagcttgacaccaaagtcatgtatcttccatgttggatatctttcacttccaatgaaaaccagccgccgggcacttcgttttcagagatacctacatgagaaactatgtcgtaccgcaattaggtaattacgacagtcattctccactctatggttgccctcattgtatgcctccccagatcaatcttcatgcatgtagaactcttgcaacttataaaacaaaacagtcatgccatgttgcgacgtccagtttccatagcggcgataaaatccatatcgttcctcggttagcgacgtcatttctccaccaaaaacattgtcctaattgatccatgccttcctagatctctcttgtatctttctcagccttcaaaacgagacaattttagttcagctgcacaccaaactcatatctccagagccattgcataatttttatattcctcttcatttggtgccacgaggacccaagtttagtgaccaaatagtttgtcctcgcagtcgcagctttattgcgagggttcccataaagtatccccacatctacatgccacatggcgtgacatctattaacacataaaagtctggtaccaagattgggccatgcaccattgttcgtttgccctctctacgtggaagcatccccccgctacaacaaatcagccccaggccaaaacctagccaccccatcaacaaccgacccatctctactcctctacaaatagcacccacctccatctctttctcgccatcccaaagccttcacttgaataattggggccccatggcaccagccactctcaagctagcctctcttgccatcctcctcgtagcagtcaccagtactgctgccgccgccgagtccccggctaaccacaccagcgagcacgccacaaacgacactgccaagccggactcgcagtggtgcccatgcgactacgacggactctctgggatggtgaccgatgcctgccgggagctccttctggttgactacgtacagcagcatcacctttataagtgctgcccgaaggtgcaaatgttgagatctgactgcttctgcgagacgatcagaagggtggtgtggaagttgaggtgcgatccaaaggcacaggagaatgaggagtgcatcgggtatttggaggagagggcaaggaacatcgcatccatttgccactgcatgaacatgcagctgtgcgacatcgacgtggcccatgcaggttgccaagctgagggtggtgcatgagaacaaaatcaaatggtggtatcctttaaactagtagatagatgatggtcataagcacaccatcatgtgtggctaataagaacttctatgttaacgaataaattggagggtttcgacggctcacgtttgctgagctccctccctccctctccccctctctctctctctgtgtttgtgtgttgtgtcatatatcgtgtacttgcggcaaggaattttatgtgataacataaattaataatgaccgttttcatctccgaattgtatttatttggaaacaaaattttggcaaatcttacaattattattcatccatataaagtccctaccttttgtaatcgtgcctaaggttactgaattgcatgcaaaaccacaagatacgtcgggtcctgcctgctgccttgatcagtgacaggcgttctccactgaaaaattgttcccggtctatgccttgccacatccatctccatgcatctcctacagcctccaaaaactagaacaaattcagttcagcaatgttccagagccacgccacgagacctcatctttttatctatatggaaacacacctccgctccacaacaaaataatcaggcccaagtcaaaactcgacaccctctccaccgccctccctcaaattaacttccaacctattaaactcgaggattacggattacccccttcgttgtgaagttgaaggtttcttctctcagtctagatctatagcctacgtgaagtttggggtagggggagagggggggagtagcagaggggggtgtgggggagggagggagagttatgttaatttcatgtatactgtttttgtttaactaatattagggtcgcttagaaggggctggaaacatcagaaataacgattcggaatgaagaagataataattaatattatctccgggtgaagaaggatccatgtgcacgtagatcgggtgggaacagacactctgctggagtagtcctggtgctcatattggcttggttgcatgagacatagtccataatttgtcattgttacaaggaaaatgatccattcagatccacgaatcttcctctaattaccactcaggtcaagccaacatgctgccaaaattggaacaaagaaatccgtgtaggggttgccgcatttatagaggtacctatgaggtcaagggaacaccgaatgtgggaacgagacagaagcaaatgccaatgatgaccgtcggattggcaatcatatatagcttgagtcagtagtaacgttcgacgattccatcgattatgtattcctaaaccaaatctccaagtgtgcgtggcgtgtaccagagacggacggacggacggacggacgaaaagcgcgtgtgcatatcctccagactcttttgttttaataaaatctaatgtcaactttatatatttcgtggcaatgatgctcgaatatacagcttgcggagaaaccacgtggatccaacaagcaagatccacgattttattgtgagatagtactatgttgcacttcatgaaacatcatggatggacggctatcaaataagatagttttatatgtcatccatgacgcaccattgataatagctctccatctctcttgataacggtcatcgagcactgcacaatatttgtggtatacgccatgtattgcagagaatcccgagttggaatctaacagcattggaattgccaacttctatatccacgcaaaaaatttatgctagagttgccagcaattttacttgcctcttagatgcatcaaggcagccccgcctgtccatgagattgactgatgagagattccggccaactgaatggtttgctgttaacagagccaaagaagtaaatcccaatccttctttggaagttcaattacgagtccaagattttctcttggaatgctttccatcaagcactcgaacatgaaagaaaaacgatcaaagagctagattgatccggctttagaatcacagatctcacgtcccaaacatttccaattacgtgctctgccgttgccatgcgggtcatcaaggtgatcaagctgatgcggtgcgaagttatgaatcgcatgaggttggtctgatcaaatcaggatgtgccatgtcatggccatgttgacacatggcattaacagagtaagaatcaaaacctccataacatttttcataaattagaggacacgtcatcttacaaatattttcaccgcaaatgaaggtgactagcatgtgggtaatcagggcacctgatatgacttccttgtttgcaaattagcctgacccaattcacattactcacatccgatctctatcatcttccatagcgccaattcgttgtgggaaaatgatttgagactgatgcttggcatttcccaagcatctcttgcagcttcagttcagcagcactccaaactcaagctcagaaaccgtcaccggacatttctactacgttaagacacctccattctacgacacatcatccctaggccaaaacctgacgaccccctccaccggcgaacccttctagcctctcctataaaacattattatttcttttaatttttatcggttaactttttctaaataatattaaaacaaaacttttgtccgatggacacggatgaacgaacagccactatggcgagtcaaacgactggcaccagtgcttatcatgacttagatgcatgacacatctcctgtgagttatcattaaagaataagtttttaaatatcaaaaaatgatgggcggcgaactggcgcagccttctggctgagagagttggggaggggagggcatttggaagcaaacattcctcttttcctcctccttgtttgagacgaaaaggaccatggattgagaccgagtttttgtcatttctagccatgaaagaataggtatggaattttttttcacatatttatatcattttttataacaaaactgtgataaaaccaccatatattttactaaaaaataaagtaatataaaagataaaagaaacagaaaaagaaaataataatacaaaaaggagaacaaaagagaagtttaaagaaagaaggcatggtgcccatcagtccaaacaacaataccattgaccagcgcagctggtccaagccgaaaaagccgaacacaaatacaaagaaacttcaacgtagtcaatttctcttagatatttcaccaaatagtcggtgagcttcctcggagacgctttctaccttgccaaaatcgaagtccttctacccgctaccatgtcttccaggcttcgaagcttttgacgccactgtcgaatggtacttccctttgcctaaaccggcacggcatcattttggatacaacgtgggctgctccaccccgccagaccctccttcatagcatctccctcacaccctccttcgactccaccgctgttgttgccatgcatcgccgctctccgatctagcgccgatattgcagctctcgtctcaacacctcgtctcctcgcctcactccaccgccgcagcctccatttttggtttgctctggacgcgatgacgattattcttccatctctctcgcgtatttcatcgagcagatgccttgcttactgcttcccgtcgccgctcctcaatggcaacatcatcgtggccaccacggaccaccatccaccgtcattggccatagctccaccgctgcgggtcgatccacggccactatcggcctgagccaccgctccatctacaattagatctattccactgggaaatgacggaaatattcttcttagacactggagcatacggtggaggagagtgaataaccgtaccgaagagagagaaggaagaaaaaaaaaatataaaatcaatccaattgtcctcccaaagtccaataatcattccttcgtcaggaaggatatatatatattcttacatacgtgtgtattgtataaatgcagtaaagacactattctttcctaaaatttagggataaatttatacttggcattcttccatataggaataatgctatgaaatttgcttgatcacctcatcagtttctcgtgccagtattgtgcaggagaattggcacgagtcattggttcccagtgattcacgagggaatggccaagtcacaacatgctatggcaatgccatttttgcgcacaatgacagaatctacgagcaacatagcacaatcccgaaacaatattcacgagaacggatatcatccttgggaacactgtcactccaccgagcactagcgcgatttatggggaatagtacagtgcatagcctcatatataccacaatatgtcacctacattggatatctagtggcactttgaaacatacccacagaatgtgagatatactgtacctagtcttctaatatctgcaagacaatcaatgtcctaacccggtttgtccctttctctttttgcaagattgtccttatcttatgcctcaagatctatttccttgcaacttttacaaccttcaaaacaggataatcatgcatgccgtgggttttgaaaagtataacatccattctacattaaaaatatgtccgcattccatgacttccaaaatatccccaaagaagaaaattttaattcagcaacactccaaaacctcagttccaagctattagatacttctctcctttttttcttacgggtccatgtctgttacaaaatattttgtacgcacagctttttttttttgatgctaaaaatgggaggcaagagccgcccagcttttactagcaactgtgagtatgtacaaagttgaaagtcacaggtggaagataagatcaggccccaggttttcatcgctggtctgaacagacctgttcagagtccagcaacgaatacagaaacagacaatgaacagatttaatagataggcctgagcaaaaccaatcagccattcgtcagttcgcggtggtctggctgactagcctagcagtccccaacagtcttcaggtgaaggacggaatagcagagaccccattagacaacgaaacaaagacagagttgaggagagtgatcactctaccgcacagagacagtaattagactacagacttcagactttagacttcataaaaccaagagcagatttcagaaaacagagttcagaaataacataacagagcagacatacaaccctattgcccatactgtctcatttcacagagaaagacgaagaagctggcatcatcagttagcctgacgctgaggagggtggaaggaaaagggcggtgaatactctcctggagagcaggaggaatgggctcgcttgatcttagactagaacacgtcgatgatttcaattggcaggagttacagaagatcgaccaatctttgaagagggataaggcgtcccaagcaacggtctgcaccgaggaggccttgttgagaaagagcctcgcgtttctctccctccagcatttccaagaaaccgctgagaagagcatcagacttactgacagtgaagactttgggaacttcgccggagcccactccgagcaggtatatctgaaagtggactgggggcatagagtgcctaaggctgcacacaaagagctctaaatcttggagaaaagagggctggaagaaaatagatgatcaattgtttcaggaggattaccacaaatagcacaacctctcaagaatttacccaacttctgatcaatagtatcccgagtgttcagcttgtgcttccaacatagccagagaaaacaatggatttttggaggaacggagagattccacaaagtggaggcgaacctacatgttattccagatgagttgaggaattgatcgaacgaggcagtggagaactcactgtcactggaggctttccaaataacacaatcctcgatgctggtaagagaaacagagcttaagagacgagtgatgaggtcaaattgagaacgaacctgagtggaagagttctgcggtagacagatgccaagagcgagatctatgcttgaagtagctagccaccgtgccggtcttattcttgctaagcatgaagagatcggggaacagagattggagagcgacatccgcaatccagttgtccttctagaaaagggtacgaaggccattaccgcaatgaaaatgtgtgcgattccaaaaagcagagggactataaatgacatcccgccgtaaggaggaacatctctgaggggttttccaagagttgctaagcctcaccctcttgtggtaagcccattacatctgtttcttccacaaagcttgatcgttggaaaggagtctccatctccatttggcaaggagagacgtgttgaactggtagatgtcctttacactaaggccaccttcctccttcagacaaatagtgctccagttgactttgcaagataacccattcgaggaggaatctctagcccagagaaacgatctcctataggaatcgatcttcttggcaacccagtgagatagcctaaacagtgacatgaaatagaggaaaagtgaggtgaggatagagttaaccagagcgagtctacctacaaagaagagaagcttagacttccaagtagcaagctgggattcaacccatgagaggagggcattgcagtctgttctagagagcctgcaacctcctaaagggagcccaagatagttaaaaggcagtgaagaagtggagcagttgagtcaggaggcgaaatcatctatggaaccagaaccaatcaaggagatagagctcttctgataatttatagataagccagacctgttcaaaacaattcaaaataagcttcaaagagacaaggtttcccttgctaggctgggtgaagatcagagtatcattagcatactggagaatcttggtgccgccaggaatccaaagattgctaagcccctcgaagacccctttggaggaggccatactgagcatgcggcatagtggatcaactgcaagtataaaaaggaagggggaaatggggtcaccctacttgaggccgcgacgacagaagatccagtctcccaattgaacattaacacaagctgccaccttagagggacagaggacattatggatccaaccgacctatttctcgaggaagccacacgatgacaggactttcagacgataagcagggatcatccgatcaaaagcttttgagaagtaagcttacaaataaggccagagctagaggacctcctggtgtgatgaataattttgttggcacaaagaaagttatcaaggatagaatgcccattaatgtaagcagtttgagcatggtcaatcaggtcgttcatgaatggctgtaacttgttggcaaagatcttggtaaaaattcgaatgcaggagtgaataaggctgattggcctgaaatcagagggtgtacatgcagcttccttcttgggaataagagcaaggatggcataattgattctagcaaggtcagggttggaggagaacatctgattgaagaaactcataagatccttgttgacaagatcctagtatcactgaaagaacaccagagtaaaaccgtcatgtcccgggctcttatccttagaagagcaaaaaacggcttgcttaaccccatcgagagagaaaggattgtagacagagctgagatcaatgtcatcatgatggtaaagattggtccagtccagatcaaccaaggagatgcaagggacgacgaagatgccatggaagtgtcctttaaaagcaagttgaatgttgggaagatcagaaacctcaacattctgccataaaatgctggagatccaattgatcttccgacgataatgagccgatttatggaagaatgtggtattgccatctcccatcttgagccacttgatcttagccttttgagaccagtagatttcctcagttgtgaagatggtagagagatcatgcttgaaggagtctcggagctatctatcagaagtgctaaggttgcctctttcttccatcttatcaaggacctgaatttgattcaacaaggaagccttgacacatctggtagaatgcctgaggtgggaagactaggccttcaaggtgtcacgggtggctttccgcttgcagactaggtttacgacagcatccctagaggagccagaggaagtccaagcattccagacaatgtcgtgggtgccctcgtgggataaccaccaacgttcgaatctaaagagatggactacccttggttcggctgataagacaagcttcacaggggcatgatcagagcagggattagccaaggcacactgcaaggaatggggaaaaagatcatcccagtcattggtaaagaggaagcggtcaagccttgccagaataggtgaagcctgatggttgctccaggtatagtcctggcccttgagaggaagatccagaagggaggaggctcagatgaaggatctgaaagctttgaaaatcttttccagtcgaggaagcccatttctgtaggagagtttaattgtcacattgaaatcaccacaaacaacccaaagaccaggaaagttatctctgattagaagaagttctttccaaaagagctttttgccatgaggatctgtgggaccatagacggtagagaaggcccacgtagcattcagaagtcgatcgaaccacaggatagaaattgagtgattaccaatctactttatgagtaggtcaaaatgccgatcgttccaaccaagaaggattccccccgcagaaccggatgcactaccagctaatcaggaagaaattcttcctccgaaaatggatcgaagcatggtcggagaggcaactgctagtttcgattcctgaataccaatagcatacaaatcgttagtcgagatgaggtctttgacaatccttcttcggagagggtcaccaagacctctgacattttaagaaatcagtgacatgggagaatgatcacgtcggcatccaatgtagaatagagggaaaaaagcaggaatccaataagaggagcaatacattagcgacagcacatccagaatagagtgaattaaaggatacagcatccaagaaggacacaagcagaagacagcagctagcaacaacaggaagacactgatcccgaaaccagtgtgtaaaacatgagattggtcttaagggatctatcatttcaaggcaacactctcctattccaaagagataaggagtttgaaaaatctttctgcatcgatctccgagatattcaccccacatttcctcccaaggtcagccagtgattccaccgagagcgtggtaaagagcaggccagcatcattgggcagggaggaaggcacatcttcagctacaggaggagcagactcagagttgactgggcaagccggggccacatgggcaaaaaaggctggaagctttcgccgagagaaaaccaacttcgaggttgcaagcctcacagaggtcagagctctcaatcttttaggcctgcaagaaacgttggagttaacaggaagaggagtgttagatggggcgatggctttctgctcaggacaagagagatgagatgtcacgccagtcgaagtaaggtcagagggagcaacaacattggttaactgtttgctactgagggtggacaaaactgttcgcaactccgtggctctggtaggtaggcagggttgaggaggatctgcaccagggtcgaaggggcccagcctgggaggaagaagtttgagccggatttgaagaggtcacttgggcaggtccagaaatcaccccaccgatagggccaggcgtcggacccaaggcctcgttcgaagggctgaaaggattcaatgccaaaggtggtggcccactaggagaggagaggggaccaggccacaagtcatcagttttcgactgcactccaagctggcggtggcagtgcctagtaagcaacatcgacgcagagcgcgagataaaatttgaatctgaaggctgaggtccaaaatgtgataatccggtccaattgggcccaaaaccagtccacaaatttcaaataaaaaaaaaaaacagaggatgaagactcccaactttttccctatgtccgaccaggagaagaactctcagggccatcgaaaacccttaggaagaaccctataaatctcccttctccccctcaaaagccagccatgaccagccgtgagatctccctcttctttctctcggaattccccgttgaagctcccaatcctgttcttgtgttcgcctcaatttctcgtcggagacctcaccgaagtcaaaggtaagttccgatcctccttcctctctttcttctcctccttcctatggctttgcacacccttgccgaccgtcggtacgggccctccgaactcgggggaaggccgcccttgccgccggccatcgccgggcaaggtgtggccgtgaacggctgacatagggaacggggacctctaggtcccctgttccagccaaagaaagccaagtgggggaagaaaaagaaaagaaaaggaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattgaagccgtgatctctcatactcgtgctcgccgaaaattggagccgacgacgctgttgaagcttgaggtaaacccttttcctccttcctctcttccttcccctcttttccatggcctcgtgcaccctcgccggccatcgggatcgtcgaaaaatccacaaaacatcatggccctattttgctctattcgaatgagccatctttctctctttttcggccaccgacatcgtcgtttgtgacgtcttatccctaagataggatcctcatccctctatccctcttccttgaaggtcctggccgccggtgactggccaatgaccaaaaaataaaagaaaaagtagcgatctcctatttttcaaatcctttaaatctcctgccggccgaacctcatcgccggccatctcttgctccaccgccgactccacttactgccagacctctgacgaaaccgtcaccctcatcggagccaagctggagccccctcgtctgtctcctgtttcggcccaagggaggccacaggaagaaaaggaaaaagaaagaagaaaaagaaaagaagaaggaaaagaaaaagaaaaagaaaaaagagaaagagaaaaataaaaaaatagaaaaaaatagaaaaaaaaagaaaagagagaaattttctctctctcctcgctctcctttctctctctttcttctcacctctctctaccctctctctttattttttctctctattttctctctctagatctttctctttttttcatgaattttatctctctagagtctttctctctctctttgattgcatcacagaccctaggataaacttgagatgaaaataagatgatctaagattgctccgaaattcatgcaatagttctgatcccagcccgatcctattcgaaacttataacatttgattcatgttgagtcatcctgataggacctctgatgatctcgactgttgggtataaaataccctcaaccgaagttttcaacgggattaaccctcacgggcctcgtccccgactccggctgcagacagaccttgtgcggactcctacgagagccggactccgcccacaactccgaccgcaagcagactccgcccggactcctacgggagccgggctccgtcaccaacttcaactgcaaggaagactccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngatccctctgaacgacgggaacgaggagcatgtggcgatgatcggctccaacctgggggaggaggtgcggacgcgtctcatcaattttctgtgaaagaatgcggatattttcgcttggattccagcagacatgccggggattgactcggaagttatggagcaccgtctggccgtcgatccaaagcatcgaccgacgaaagagaaaattcgaggtcatgcaccagagaggcagaaggcgatagccgaagaagtggacaaactcctcaaggccggattcattagggaagtcaattatcctgattggatttccaacgttgtcctagttaaaaaggcaaacggcaagtggaggatgtgcatagacttcaaaaagctgaataagacctacccgaaggacagctatccccttctcagaatcgatcaactggtggacgcgacctctggccacgagctccttacctttatggatgcattctccagttataatcaaatcaggatggtgccggaagacgaagaaaagaccgctttcattactaactgtggcctttactgttacaaggtcatgcctttcggcctaaaaaatacaggcgcaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggatcacgtcgccgacctcaaggagaccttcgacgctctccgaaaatatagaatgaagttgaacccgactaaatgtgctttcggggtagcctcgggaaagttcctgggcttcatggtgtcggagcgcgggattgaggccaatccagaaaaaatttgcgccatccaggagatgaccgtcccgaagtcgataaaggaggtccaacgccttacaaggagggtagcagccccgaatcgctttgtcgcaaggtcggccgaacggtgcctacccttctttcaaatcctcaagcagccgaagaacttctgttggacctctgagtgccaacgggcgttcgaagaattgaggagctaccttggctcacccccgctgctggcgaggccggagcctgacgaggaactgtttttatacctggcggtctctcctatggctctcgcggcagtccttgtcaaagaagaagcaaaagtccaacggccaatctactacgtcaatcgcgtgctaagagacgccgagaccaggtataccaaattagaaaaactgacttacgccctgttaattgcagcccggatgctccgaccctattttcaagggcacaccataacactgctcactaaccaaccgatcaaggcgattctacaccgggcggatgcctcagagagaacggcaaaataggcgatcgagctcacagaattcgacatcaactatcgacccaggccggtagtgaaggcccagatattggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggccctgcaacgcccaatgcgcccccacagccctgttagggacaggaggagaacctcgccctaacttgagcaaagtcaaaggtccggttccttttagaccggatggagggagaggccctgcaacgcccatatgcgcccccacagccctgttagggacaggaggagaacctcgccctgacttgagcaaagtcgaaggcccggtttcctttagactggatggggggaaaggccctgcaacgcccatatacgcccccacagccctattagggataagagacgaacctcaccctaaccagagctgaaccttgttacgacagaaataaggaaagaacctcgccccgacatcaattaagatctggtcattcaagaccaaatgagaaaaagggggaccttcaccagcggccccttcgtgataaaactccgttcggactcctgcgggagccggacttcaccctcgactctgattataagaaggctccgagaaccgaactccatctccgaccacaactgtagaaaaacttcatccgggctcctacaggagccgagcttcatcctcgacttcgaacgctggtaagctccgtccggactcccacgggagccgaattttgcctgacttcaattacaggtagacccccttcggactcccacgggagccagacctcgccccgacttcacctgcgggagccgaactcccgcagccccaccaaaaaaaaaaagggagaagagagaggagaagggaataccacaataacaacggtaaaggaaaaagttcgacggacaatgattcgacataaagtacggacgaggtaacaaaatcaccttctcattttttcgactaacaagatgtacgttacaagacccggagggccagaaaagaatacattattacaagactcgagaacatggcttggaagggatacaccggaggccacttcaagctgcaaacttctcttcccatttctgtccttcccagccgtatttttcagtgcgtgtgacaagcctatcggctctcgcccccaccttgttccgctccaccttcgaaatttcaaccctagggggaaaaggatgggatagattccaggggacagtgagggcaacgacagcagcgatgacgacctgtttcaagaagaaccggagttaccccggaggcagcaatggcgtcggtaatatgtgccaccaccgaatgctccagacaaccatcgtcctaagcattccgacaaggtcggcatgcgctacttccaccatccccgcaacaagtttcgctgccccaccatcgacgccgaccgcttctgatccctcggccccgacgacatcaaggatctcgccacagcttgtgacgacagctccgccctcttaaccggtgtcaccccgtcctgctactccaaaattctcaggcagaaccccctcaccgattgtccccgttattaaacccctgttgttgaaggaattcttcctcgagccccctttaaagcgacggaaaccctcagcggcagctcgacaaccggagaactcgcagactgctattctcctccttgcgctcttccaagtctggggcatcctctggaggttggcctccggggcggaggccctggcaggggaaccccttagagaggaatcgggaggggactgaagatggcagagagacgacaaagaccagcatggaggatgctcggaggtggaaggggcaccgatagagtagctgagtgactgagctctcaggcgaaagaaaaatatcgtcctttaggcgaggtatggcccctggaggaggggtggggggtttaaataggcaacggagcctgacgcaattatggtggcaggtgcccctgggccaaccaatgcccaccacgtgtcccactcgtcgcgacctggagttgaccgttcgcaaactttcatggcatggcgcttgggatcacgtcctggtgggagttccgaaaaggctcttcgggtcgccctaatcgagaaaaggctccagcatgcgcgcattaaatgccagcacatctggaggtggtcgtacacaggattcaaggggacaacttcggctatgcaaacctctctgtacttccttcattcgaatttcaaactcgaaagtaggggattggtgttgggtatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaggcggctgtgccgcatgccgttgtcaggatcgacagtctccagcagtcgtacggtgtttgaaggagcccaccgactataggtcggcggctggttgaggggcgtcgggtggaaatacggagatcctccgacagtcagtcgggcgcgttgtgagagtcggacatcgagctccatagttcgaccgatcgagagcgaagaaggtctgtccgaccgacgtatactcggtcggtcgatgacggcagccgtcggtcggcagagtcgggcgttggtcaagtaggcccgatggtgagtcggcgtgagggggaccggtcggtatatcccaacagttgccccctccactcctgagtttgatgtcgtgttggctcgcgtgaacatgtgggcgacggcttcggacgaaaggagtggttttccgtcacgtcttgccccgactctggagatcgcattaacgaacaatccgatgtcggtcgtctcgacagtaggtcgagcctgcacgtcgggtcggaggttggccaacctccgaacgttgctcgtcgacacgatcattctgcagagtctgatagtcgagtagcgtccgacgtattcagataggataacgatggcaagtcgaatatccattgttcggcctttggttgggcatgcacgtcgggacgtatgataaacggtggcaagccgaatatctttcgatcgatcgtgaccaggttggtatgtcgcaagtcgaatatccatcgacatagcatgtcgagtcgtatgatagacgatggcaagccgaatatccttcgacctatcgtgaccggatcggtatgttgcaagtcaaatacccgttgcccagatcttggtcgggcgggtatgtcacggttgtcttggcattttgccctttcatagtcgaagctaagttggcaagttagccagccgcattggtcgaagccctttgccctcagaggtggggggccgtcgtagatattccgtcccttcgatcttcgtcatagaattcgatgtgtcgtcagcgatcgaaacgtagattgagccattggtttggcgatcggcgatcagttcgacgatggagtcatagattcggcgatcgatgatcggttcgacgatggagtcatagattcggcgatcggcaatcggttcgatggagtcatagattcggcgatcggcgatcgagccattggttcggcgatcggcgatcagttcgacgatggagtcatagattcgacgatcgacgatcgagccattggttcggcgatcgacgatcagttcgacgatggagtcgtagatttggcgatcggtgatcgagccattggttcgacgatcggcgattagttcgacgatcggcgattagttcgacgatagagtcgtagattcagcgatcgatgatcgagccattagttcgacgatcggcgatcagttcgatgatggagtcgtagattcggcgatcgatgatcgagccattggtttggcgatcggcgatcagttcgacgatggagtcatagattcgacgatcaacgatcgagccattggttcggtgatcggaccgcgttggtcgaggccttttgccttcaaaggcggaggctatcgcagatattccactccttcgatctccatcgtagaatctgcgtacgaggagtagagagaggagtataggagtcatacctggggtgcgtcggccttggactccgccatcgaggcgacctcaggttccgtcgcgggggtgaaacccgacggtcggtcgggggcctgctaggctctaccgaggctcgatccttccttcgcttctccttcgggcccttggactcggtcaggcaccgatcggaagctccttcgttcgcgcatatgtacttgtacgcgcgctccagcagttcggcgtacgtccggaggaggatcttatccaaggagtatgtgaatcgggatgccctcagcccccgcttcatagccgaaatggccatgtcttcgttgaggtcccgaacctcaagcgtggtcacgttgaatcgcgtcacgaagtatcggagcatctcattttctccctgtttgagggaaaaaaggctgtccgagattcgtggcggcttccggctggtgctgaagtgggccacaaaagagtgctcgagctgcccaaagaagtggatactttctgatcaaagactggagtaccaggccctggcaactttgcgaagcatggtggggaagccgatgcaaaaaagagcatcggtcgccccttggatcgtcatgagagccttatagctctccaggtagtcaactgggtcggtggagccgtcataaggctccacgtgtggcatcttgaaccgactggggatcggttcgtcgaggatgagtcggaaaagaggttgggtggtctgaaagtcaacgtcgtttgaggacttctgtccgtccacctgcaactggacaagccgacgatcgatttcttcgaacctgtattcgtagtcgtcgatccgtcggtgctgagagaccccgggggtggagtctctcgatgaatccgagagggaggcggacggtgttcgcggccgcttctccttcctcgctcgttcgagctgagagggagatgaccgtcgagaccgatggatgtcatgccgcggccgcccctcctcctctcgatgggagccctgtagcaggtgctcccgaggaggtgacgaagaccgacgcgggcgtcggcggctgctcttagagggcatcgaacgtgccgccggttgctctactggcgagggcggcaaccggattggttgttgctgaaggcttttgaccgcatctgtcagtacggtcatctgccgcatgatcaccgcgatctgtacctccgtggtcaccgcgggatgcggagagctaagttccgccatggagggtggaggagaggcctctttccgacggaaagagcgcctcgccgatcaggtgaccctcgaccactgagctcttgttcttgtcatcttaatagatgtttcgagtttcgtgggggttgtaatccctgtcgctgtcatccccctacctggcacgtcaaaacctgttgcggccaatcccctcgtcgcctggtcgtcgggaacgagcgcctgtccgcactgaccagagatgactccgacggggaccctccgatggtcaagtcagagaggagactaggcaacagtagaaaagaatcaaggagctcaacgagagagggtgagagcgagagctcgagaggaagagtttaagggtttcgaaaagacctcatcagcactgttgccttctccggtttatagtggagcgcggcatggcgccgtcattaatggcacagacaatgaaagaattgtcaaatcaccgaggactgtcagagtcaccgtgaggttgtcaaatcgctaaggttgaccacgtcttaggtgggataatgccccaagacggctgtgccgcataccgttatcaggatcgacaatctccagcagtcgtatggtgtttgaaggagcccaccgactataagtcgacggctggttgaggggcatcgggtggaaacccggggaccctccgacagtcagtcgggcgcgttgtgggagtcgggcatcgggctccatagttcggccgatcgagagtgaagaaggtctgtccgaccgacgtatactcggtcggtcggtgacggcagccgtcggtcggcagagtcggacgttggtcaagtaggcccgacggtgagtcggtgtgaggggaaccggtcggtatatcccaatagatgctataatccgtgcctgaacctgaacccttgacctttgcaatggctggtggatgtagtttttaactttaacaaacgacaaggcttcacctccctctaccgaacagggaaaaatggtgaagagttccatttgcttgtatgaacacgaccagctcctcatgcaaagaaatttctcagaagctgcttccgttgtctcaagatcattcaaagtatcgtatgcactcttccagacttttatgtatttattacacatcatattggggttgggaaagttttggttttcagcgttttggtttatattgttgctgtagatcagcttgagttgtccatccttcactgtgcattactctttaccgttaatttaatattgttatggtttcataccaaaaaaaggcatcatatttggctgagaaagatgatagacatgcattgacttggcactcatcatgcatcaaatcgggtcccatatagaagatgcttttatggccgatgaagtaaataataaataatggaaatttaataaagcatcgacgttacggcctgagaatctttgacaatgcctagaaaatcacttccctgcctgaaattcaatacaagcaattggttaggttctagaacaaagtttgcactaggtctgaccatgaatttctttgccaatttaatttttattaattatttgtttggattagatcgatgtaacatccaatcaaaacaaaaacagatcaaaatcaaaggtgacaactgtatataattaatcatcaatttaattgttaacaataatttataattcttgtgatcattagacaatctaatattgaatgagttgttgataatgcttatacgttgccatatctattttttttttttctcccctaacttgatctattttggatataatcaagtaatccaatgtacacatgttatttactaattttatttaaaatactatacatcgtctccaatcagagagaaaataaattaaactaataaattttgaatgcagtcctatcgcaatcaacttgcaatcgcatgcccatgcattatttattttttttattaaaacagtcacgatcttgttggcatgtccctcttcttttccgatcttaccattcgctgtctttgcctatcagccgcaaccatccaataataatattctttctaagtttagttctcttaatcttattcaaagtactataattttttttttttgtatatagacagacgatcaaattaatctagttcaagaatagtctaaaaattaaaaaataaaatatctttcaaaacctatagatagtcattgtcctgatatcatctccagcctctgatgtgcttaacaacaaaggatatcatccaatctgctgcactgttggtcaggacattacaatgtacccatgaatgacccttcaaatattgtcaaaaagaagataagcctcgaggtatataaattccttttagatccggttgataatcgtcagagaatgcttctcaataattattttctgcacccgcagttttcgaaccgcacagatgacaccaatccataccgcatgaagctccgcattcgatacagacgatgagactccatactataattatatcccattcaaaaaaataataataattaaactaataagttttgaattcaatcgtaatgcaatcaacttcgaggcccatgcattatttattttaaaaaaagccaccatcttgttggcatttcactcttctctgtgacctcaccgttggttgtttttgcctaacgaccctaaccatccaacaataatattctctgggaatttaattcacctaattagggtctatttagataatcaaacccaaaatcccatgtaattcataggtttttgttttgatgtagttcataagttgggtcggtacaatcagtcaaatcaagctggatccaaacgtccagacaatcctttaattttaggcccaattatttaaacagataattaatttttttaattagagctgactaaatcaatgtacggaatcaataaaatataaaatcagattaatttcacgggctacagccttggattcctgcacctaagtatttttttaaatattttaaactgcttgcttgctggtttagtcctgtctccgtttcaacacctgaaagatcttacgtcgccgttaacttttagtcatttatgcttgaggaaattttttttcttaaaaaaaaaaagggaatctcatcaaggaatgcaggaaaaaaaaagaatggtagaagaaagacggccaaccatccaagctgctgtctgccgttctatacgtagatataagagacagcagcttgacatatcccatcagatctaaaggcgtccgagtttgcggttggttctctatccaagattctaactccatcattggtatttcattgccttccagcgttccaatagctgtccttgaaagcttccttcagttcttgggtgttatcttctctacctataccaaagcagccaacttcgtcggcagggtatggtacctctcttttgctcttatcgttgatttccgctgaagccagcaagatcttttggttcctattcagtttttttgcccctctttttagcatatgtaagtacaatctttaaacttgatggatttgatttggaagacctataaatgctaatatcagttgggcatcgaagaactggaataagggaacaggtgaaaggaaacttattatgaaattaatgatggagagtttagcatgtcttataatttggtttatggtaacttcaaaagatttttatgatttatcgttgactaaaattctaaatttatgtggaaaaattgtgctgcctgctgtctatttgtcattcttatggggtttttgcttcttgtgcttgtttttgcttcctgggatgcctgatcatgatgaaatccttgtgtcctcaaaagaagggaaaaattatacatccctgagtgcaagcagtaaatagcagcagtgtttctggtttccttttctttgggaaaaacttttcttgattttgtttttttcattatctgaattatgaatcgaacgtgtatatggtgaagatgaagtaaaatacagaatcaagcttgtcccttaaatatgcaatgatccttgagatacacttaacatgagctgagaaaagaggaagtggaatgcacgatcaatggtggcccttaaaaatcttgtggcccttaagacaacactccaatgggctctatcaggatcgtcactaggtctactcagggatcctacgaggttggccgtgctagatcttgtttgacttattgtgtacatttattgccaatcctagattctcctagttgctcattaggttcaaaatgtttgtcttcaaccaattactacattcttcaggagtgcgcaagcctccctgcctactatcttgccttttaaatttcctgttagatttaagttacctttctagatgacaactaatgatagaaatttgcttagacttttcatcaagtctttgtcgcttgaagttattttcgatttctatcgttttttgatgaacacatctttagatgatcatcatgataaggattgttaaattctttgcactggagtggttacacctctttcgttctcaacaaaagtaattaatgctcctaagtatcctttatggattctatgtcctcttctacatctttggtcattctaagctgtaagagcgaatactctttagtatttatttatttacttatttgagcaaacatggtcggatgaactcttactccgcaacttttgaccttatctttttttttttttttgttatatgaacgggaggtagcagagctacccacattttattagaataaaagctcaaaatttataggtacagattcaaagagcaacaagctctgcttagaactcattacaaaaagaagatttatggacaataacagaacccatatcccacccaaagaagaagttttatgggcaaaacaaaactcacatctcaccccaaaaagaagctttagggagtgggatgcaagggactgcaatctattccatagattttgatgttgcgcctgaaacttagtagaacccagatatctccaatcaaaaaaagattggaacagcttctgtaagactgagaacattgaattcttcttatttagaaagatgtgagcatttctctccctccaaaacttccaacaagcagctacaaaaagttgatgccccaacttctttgccaacttgcctttgttcttctctctccagcatgtctaaagatcaagaaagttcactggtctttctttaagattcagctataattttatggttgcccaaatactccttgcaaataagcaacgaaagaaaaggtgattaatggactcaaaattggcaccacaaaagcagcaactagtactaacattccaatccttccaagcaagcatttcaccagtgtgtaatatgttcttgactgccaaccataaaaacactttaactttctctgggctcgatattttccaaattatattttgaaaagggcatctcaaaccatcaaaatttagaaacttgtaaaaagaatcaacggtaaaaaggccattgcatgaaagcttccaaataggaacatttgcaatacgagatggcatcgtagaagagagaaggttatacaataactaaaatcgatatgattcatgccttgtcaaaggacccatcaacaggacacaccacctcaatgtgctcatattccaaaatgatgcaacaggcaagttagacttcaatatccacatataaaaatcatcaaaactataacaaaaagaaattgcatcaacccaagcatcttcccataatctaattgacctcccgttgccgcatttaaaagccacacaattccaaaaagcctcattcttcaaactgatatccttccaaatgggagatagccccaaagtcgaccttcttgatcttatcttaacctataaatatactttaccaaccagccaaggttgactcttgcttaggagaatctgtttttcgggcaaatccaaattgatttccttatttgtcattttgtaaataattatatcaatgatcattgctttgtcttcaattcattgagaagtacatctcagattagttctacagatctaattgcttcctgtggacaacaccacggtctgatccagcagatatcatttttaaatatatatcacgttatatctggttgatttagtctacaaaagataaattactttcatgctgcaatagaacagagttatctcacctttggttccatttcttttcccatataaagcatcccaggatttatgttttgggaaaaactttgatgatttctttcaatatatgagcggatttccagaatgacaggggactaccttaactcgttagactctacttgaggtaacattaagttcaaagtagggtattcccttcatataaggaatatacatggcgtattaatttcagatgcagtggtggcaactcctaattggttgccataggtatcttcttagttgaccttgactttttagtttgggttcataaaatcatccattggtggtgaatgataatttgccaagtacacctgtttgattggctaatcccctttaagtaaagataaaattagaccttaatattattcataactactttcatttcagatgaaaacaaatatggttattgcaatgactaacatcaatttcactttcatcattattaattcaattggcctctgcttgactctgatgcaggtcatgggcttgtcttgcttggctcagtgtggagcaggaatgggatctggacttggaaacgaaagtgtaaagttcttatggaaacatttgaagtcccgagcaggctatcttctacattacaagaagaaattcaagaaactcaaagaacgttttgagcatttaaagaatgtaagaaatgacataaatcgatctgtcgagacagctaataggagaggcgaagtgatcaaggatgtagtaactgcatggctagagaaagtgaatgaactggagacagaagttggtaatatggaggaggaggttggacagaacaagagatgtctcaaggggttttcccccaactgtcgtcggcgctatcaacttggcgaggaggctacaaagaaaaaggctgttgttgagggactccttgaagaaagaaactttgatagtgtatctcagcttcctcctccaccaaccattgagtccatgccggtgggtgattttatggccttcagctccactagaatcgccatggatcatgttatgaatgcgatagaagatgagaataagcacttgattggaatatatggtatgggtggtgttggcaagacaaccctgatggaagagattggcagaagattgaaaaaagataagaagtttgatgctgttgtcaaagtggtcgtatcacagaatccaaacatagagctgatcagacgtgacattgctgaccagttgggtatgacggcactcttggggagtggtgaatctgcagctagggcactggctactaggttgggtaaggagaagaaaattgcgataatgctggatgacatatgggctaggttagagttaaaagacattggaattcctttcggagatgatcacaagggttgcaaaattttactaacttctcggaaatctgaagtatgtgattcgatggaaagtgatgtttcagtcctagtagatgtgctgtcagaagaagattcgtgggaccttttcaaaagtaaggctggaaaggttgttgaaacctctgatgtagaaccggtcgcaaaaaaagttgcaaaggagtgtggtggtttgccgctggcaattgttgtagtcggaagggcattgcgaggatttaaggaaagaagtgtctgggatgatgcactgctccagctcaaacaatccactcctacaaacctagaaggtgtggaggaacagttgttcaagtcgctagaactgagctacaaacagttgaaaacagatgagatgaaagtgttgtttttatactgctgcttgtttcgtgaggactatgacatcagtgagaatgaacttacacgatatgcagtgggtgagggtctattgaaaggtgtgtactctttggaggatgtacgaaggagattgcatttcttggttgagaaactgaaggcttcatgtttgctattaaccagtgataaaatggggtgtgttaagctgcatgatgtggtccgagatgtggctgtatacattgcatccaaagacgacaatcatttctttgtaaaagctggcttaggagtgagagattggccagagggtgaaaactgggaagcatgtaagagaatttcactgatgaataatgacctacaggcactacctgatcggccaaattgccccagggtagcgactctattattgaacataaatcctattacaactggaataccgagcaatttctttcaaaggatggcagcacttaaggttttagatttgagtgacactgatattgaatcattacctttgtcactggcacacttgacaaacctagtgacacttcgtctggacagatgccaaaaattacaagatattacaatggttgagaacttaaagaaacttgaaatacttggcttgcagaaatgccgtgttagtgtgttgccagaagaaataggaaccttggtcaatctaaagctcctggatatatcaaactgcagtgctcttaggataccacctaatttgatacctaagctaagtcggttggaagaactgtacatgataggctgcaatgccaacagagatctccttgctgagattgctttcttgaaacgcttggtcagattacatgtgtatgtaagggatgccaaaaacttttctcaagattctctccctgtcaatgcttgggagaatttaagccacttcattgtttataatgaattagattggtttttactggctgctcagtaccaaaaaaatttttatatcaagggaataagcaactcactgaattgggctaaggtatttttgggcaaaacagaggacctcatgtttgatgactgccaatgggatattgtgaatttggtgaaattagatgaacaaaatggttttgcaggcctgaagaaactacgtattacaagatgtcatcgcatagcctgtcttcttgatacaacacaagtggctccttcaaatgcatatggtgagctagagattataaacctttggaatttggagaatttgaatggaatctgccagggaccgcttccagctctatcatttggaaaaattagaatcttggatataatgctgtgcaagaagttaaataatataatgtcatgcgacttgctgcaaagagtgcattgcagtctagaagagcttgccattaaacattgtgatgaaccacaagtgatattcaattttgatggacttcagcaagggagtatcatcctgccaaatttgagtaaattgacactgcagctattaccaaatcttaccaccatctggactggagtcgtttctcagggaagcctgcagaagctgagcactctggaagtgtctagctgtaacaaacttgcatatctgttctcatgtcagttggatactggacatcaaagactgctaccacctgggaccttcatgaatttaaaaaagcttaaaatatcaaggtgtagtggcttgagctctctcttcttgccaagcatagtgcatgagctcctgagattggaaagattggagctcaaagataatggagcaatggagaagatagttgcagaggagaatggtgttcggctggagaaaggagcattccccttgctgaaggatctgttgctgataaacttgtccaacttgagtcgcttctatggtggggaagcagcagcaatatttcttgattggccttcactgaaatacatcaagctagggggctgtccaagtttgaagaggctcccaattggaccagaaagtgcaccgaagttaaagaaggtgcatgtagcaggtgatgatgatgttgaatggttccaaaatttggagtgggaagatgaaagcatcccttcccgctttcgtatctggtaagtatttttccaagcgtttgctttgtttcatgcatgcttgctttgcaaattgttctctagtattttactcgagtgtcttctttataaaaaaattgaaaaaagaaatcttactccagtgtgtggatactggattgcctactgcagcctcggttcctcgagtctcctacgaccagtggcatagcgctacattttgctgccaccatatgatacatattttggcacccataaattgccttccatggtcgtaggacatccctgcaatgggatgcgtaatatatcaggattttttcaattttatagtggcgcaattgcaaatcagcattggaagattcaccttataatttcaattggaagttgtgcctacttatttgacatgcaaagtgattccttttttttcaaaaaaaaagttttgcggtgggactaccccaattcgttgttgggtctgccttacacatttgaattagaattttcacagcccaaactcaaattgcccttaagtgcaccatcttttcatgctcagccaagtcaacggcatgatgccggtaagctattcaaggcccaagttggactatctattatctggcatggattgttgttgcaaaacctgaagccactcccttagctacaatgcaaaggcactaaagagttcattaagctacaatccttatatgcacaacctgctggaccttccagtgatgctttatttcaatctaaccaacagagtgtggtctattatagaattcagcaaaaggcagtttggttattgggtgctctgtttttttgttttctgatatttgtttcatagtggctaactcaatatagtgctaaaaacagcgaatcagacgccgaaagcgattcagattaagcagatgattgtggagtttgctgctttcaggtgtaagattggggagatggtgcttaatgcagtcagttgactctccatggtgcttggaatgtcttgtttctatttgcttatttcttatgccttttgatgatgttttgcattcctaatgatttgcaacaaacaatgtgctttgtaagttgtaacaagtcagatgtcaatctacttgttgtttgattttacgtttaattttggactacttctctccaaaagttttattgtggactactttagaccagccaaaatcctattgggtaacggcttattttttttggttttttcaatacttctcttcagattccacggttgtaaggctttcataattgagaggtcttggtctctaacatcctgaaaggggcctaaatagttttgcatcaagtatgaggatgctagtgtatcaaaaatagggaggactgctggatgtacaatttgagtgcagatgaaactcacctggattacagcgttgtgtatgggagtgtgtgtctatatatatatatatatatatatatatatatatatatatatatatatatatatatatatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatacatatatagatgtgtatacatacatacatacatatatagatgtatgtatatgtatatgcaaaataatgtttttgaaaggggagagatatataggagaaaaataaaattaaggtaagttccttggccatggttccattccagggtttgtccatagcgtcaaagttaaggctttgtgaaatttgcggatccatatggatttaaatatctgattcaccttcggtggctgcccagatctctataattcaccacctgcacagatctcaaagtgacaaatggttgatccagcggggtggatttgtgtgaagcaagttgaatccttctttcgcaaagatacacccctaagcttgtctaacagaccaattgggctctgatgggttattattaatctacaaagtccagtcccatcttaaggtgggcatctgaatttatcgccttaagttcccgctggaacttgtttatcttgatttagtttcaaggatgcttcccctatgtcaatgatcgcgattttcagtgacatgaatcattccagggcatgaaagtggatcccggaagtcattcaggtcacattaaaaatggtttccaagcatttgactaccatgaaatatagctttgtggacctatgagtaaaggagcctctggctaaccacccacaagaaaaatcccaaactgcccagactctaattttttatcccatcgctaacatggctttcgatttatccaactgttttatacgtggctggtgtggtaaatatatcaaactttaataagatcatttcaaaatgaagctcaggacactttggaagcccccttcttcctcctcaaccccattcattcccattcctttccattcaccgccagagcttgctttcccttctcccttgccactgccatgtcagagctcaaaaggctcttgaagagccttagatccaaccctgattgagctatcagcactcactccgacactcccacactcagggcctcaacatcggtgctggagctccaagagaagaggagataaagatgactgataaagaatacgtcgatcggtgggaagttgacaatgatagagctctgaactctggtgggatccagtggagcatatcatcccaattttaaggagaagagaggagaaaacgaggaggcgggccaaacaattgagatgcgtcatgaggacaagacggcatggagcatggtgttggtcaatgaagcacggtgtatcgattgtaaggagatgagaggtgaagacgaggaggaaaaggagacatcagcgggatccaatggagcatggtgtgcgagccatcaggagaaaatgaggaggtgtgctgcacggtggagatgcgtcgtgataagaagatggtggtagagtacagtgtctatcagtggagcatagcacaccaaagaggaaaagaagaagattacggtggaggaattaaagtggagaagatggccaagagaagaaacatctagagaaaataataacatattattctctttttctaaaaagtaatgaaaaataggcaggccggtaactttaggcagcctgccgttgagctcttgagaacaaaataccttgtgcgacctcacttattggacggtctggaatgctatagctttctataaaatattattaaagtgcaccgtagcaaaaccctctcagcaccgggtgtgcggtatatttagtatatcagtttacacattgtcaaagttgcacactaatagtctcataaaaaaaacactaacacatgataatagctgtctatctttgaatccatctatcatctatgcctacaattcacaagttagaccagcaaaatccattcaaagtacatcaatcaaggaaaaaatgtcggttagtcacaagaaataaaagggcaaagtagacattccatctaccatgtgttatgggctaatcatgaaataatctcatgaaccaacataatagattagctgacatccacgatggtagaattgatctaaatttgggactaccaacgcgtcaatacagtgtaacttttgcgcgtgcgcaaaagttttgttgcttttaatgaaagcttgatgatagcagttagatcaccttcaatcaaatctcgagaaccgatcaggtgcgggatggaggagtcgtttgcgagctccctttggcttggtacggacgtacacggtgggctctatagtcaccgataacttgtccttttttttttttaagattaataacttatccttctgcgagaagcattgtcacgctacgaacccaacatccggatcggatacgtaatagccgcatactctttagagcaagttctaaagaatatgcaaggtcaaaataaatcattacaatcttaacatccataacaattaattttaacaataattcgtaaaatcttgcataattacaaattaaatttcttcaatcctctgatcagatactatgacactctatctatccatctgctcacctataaatctaagccatagccaatcatgaacgtcctgcaactctgagaagaaaaagaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatttttattcaataattatttcatgttttatctttcatttctcttttcataatcacatgatttttaacattttctttctggctctggactaaccaagtctatacctcagtcatcgtccggatcgaatccacttaaaaagcctttcaaggctgtcccaggatgagctcctggccggctgtcctacatacaaaagcccgtgagaggctattccaggcataagctcctggcgggctgtcccagacatgagctcctggctggctgatccacctgtaagccagtgggggctgtcccaagcataagctcctagcgggctgtcccaggcataaactcctggccggctgttccatatgacaaagctagtccataccatatatctctttctttttatttaatcattatgtgttgatttcatcaaatcaattctgtcttgcattatgatcaattcaggtatgtcatattcatataatcataccatcaatctctgatatatatatatatatattgacataacatactcatgctcaaaatcaaataacaatatctcagatataataaattcatcgatctcaaatccgactatacataaccaataatgcaagaccaacagtaaaatagcatatttataatggtgatcatatatagggattcttacctttatcgatgactgatccaagcacagaaatcaatgttcttctttgatttataattttttttaacaaaatattccactcgatatcatatgcagataatcatcccttcataaccctaatcaaatataaaaatcatatatggagaaaattatccgataatcaatcctaataacacaaatctaggacctctctcaggattaaccaaaattaggatttgtctaagggatcctccactgatccataagacttctagagagagaaaatccatgaagaaaaaaaaatttagagagagaaagtggagagagaaaatagagagaaaaaatttttgtatccttcagacgaggaaatcatgatcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagagagagagagagagagagagtagtagtagtagttagttagtttacgtttacttttacttttcttttctttttctttttctttttctttttctttttcttttctttttcttttcttttcttttctttcttttcttttccttcttctttttcttttttttcttttccttcttcttcccacgaccctctcttgggccgaaacaggggatctcaaatcctcctctttgctcgaccgaccaagggccgcagccggcatgacggtggtcagtgacaaaggccgacgatcccacagctcgaagggaccaaaccggtggtcgacggtgaccaccgatgtcggaaaatcgaagaaaaatgggcaaaatagaggtttcttctgcaacaaaatccggtgactctgatcgccgacgagcgtgcacaccggcacaggaaggaaaggggagaagagaggaaggaggaggaggctcaccttcgacgccggtgaggctttccgacgagaaattggacagacacaggtcggatctccatggtggtttttcgatgattgccactgacttgatcttgggtctttggtggaagggagagaggagggatctcctccttaaatagagccggagggggctctttccgactccgattgggagccgatgaacggaggaagaagactcccccctgttttgtttttttttttaatatgggttgtgggctgattctaggcctaattgggccaggatgttacattctcccctacttcaaataatttcgtcctcgaaattaagttatgtcattcgagatacatatttcaaagtatacattcttcatgtcattcttaagcttacgataatatcttatatattatttatttctcatgatcttgttataacaaaaattatttgaaattttaaattcatcttctcttattgatttctcaattttttgaagaactgtaacattttggacttgtattaatataccaccgttatctgtctaatacattctactcgaaattcataattatctcaggctacccttgatagaaaaataaataaaggtcaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctctctcaggattaaccaaaattaggatttgtctaagtatctggatcctccactgatccataagacttctagagagagaaaatccatgaagagagaaaatttttgtatccttcagacgagacaatcatgatcgagatcatcaaagataatattaggatgactcaatatggattaaccatgattgatgttatcaattttgaataaagatcggatcgggatctaatctactgtacgaatttcgaagcaatctcaaatcattttattttcatctcaagtttatcctaagatctgtgatgaaatcaaaaagagaaagacactagagagataaaatctataaagagagaaaaaaatttagagagagaatctagagagagaaattggagagagaaagtagagagaggagagagaaaagaggaagagaaaggagagagaggagaaagagaaaattctttctttctttctttttctctctcttcttctttttcttttcttttcttttcatttttttttcttttccttcttctttttcttttttttcttttccttcttcttcccacgaccctctcttgggccgaaaccgaggatctcaaatcccctcctttgctcgaccgaccaagggccgctaccggcatggcggtggccggcgacaagggccgacgatcccacagctcggagggaccaaatcggtggttggcggtgaccaccgacgtcggaaaatcgaagaaaaatgagcaaaatagaggtttcttccacaataaaatccggcgactccgatcgccgacgagcgtgcacaccagcacgggaaggaaagaggagaagagaggaaggaggaggctcaccttcgacgccggtgaggctttccggcaagaaattggacgggcacagctcgggtctccacggtgattttccgacgattgtcaccgactgcatctcgggtctttgggagtcttctcctctgttttgtttttttttttatataggctatgggctgattctgggcccaattgggccgggatgttacaagtataaagcaagaaagtggacaagattttttctaaaaaaaaaatcaaggtttttttattgaacataaaatatatattaagattattattattttttatgaggagactgcatcaaactacatcctgcggaaaatgagaacaaaaggtcatgaagttcgacaaaagcagagtaaaaatggtccttgcatcgaactcatttgtttggcaaggtggaaggctttcgttagttctttttttcgggtaggatggatttggagatggttatcgagtcagatcaaattaaatatgaattggatatagtttggatcaaaaatttagcaatccaaattcaatctatttattaaattgattaaaaatttagattaaaatctgatctttttattaaatagataatataatccgatccacataatttatttattaaatagatcaagttagattaaatgagttaaatagattggattaaataaattagaaacatattaagtagattttaaacagattaaatgagttggattataatttaatctaatttttaaatagattaaaataaattaaatggatcaaaaatttaaatctgaattcgatctatttaataaataagtttaaatgggttgattcatttacgatcaaatctatttatattaaatctaaatttttttaaagcagattgttcacaaatttgattgatggattggatcacaaatcaccatctttagatggactcattgctatgatatcaatccaaaaggggcatgagatccattcctgagagaaataacagggttttggaggggactcaaaaaaaatgattaattggataacaaacacaatagcccaggttgattgtgttcaaggttattttcatccttataaattaactagcttataaccccatacgatatataggatataattttttaaaataatatttaattttatttatttattttattttatttattatatatattttaaaagtcatcaaaataattaaaaaatgtaaaaggtggtaattaggtgaatgtccaattacaaactaatgcaagtggttcactcatcatgtttatactcattttgatggatagagtcataatcattcatcggattatctttcatattgaataaacctcttttctctcaaaagagcaatttaggacttaagtttaaacttaaagccggaatcaagcaaatgggatgagtgattggaggctgtccttagttggcttgccatttagattagattattagattagattagattagccaatgatttctattccaacgacccgatttttgctagcgttttgtggcctattcagcattagactcatagccaaattgatccgatccaatggactacacacaacacgttattcttcattttatcacatattgctggaacttcaggaagacgaccaaatcccgagcccccaattccccttctttcaagtgtggagttagaaaagagatagccgcgccgctgcaacgaagtagcttctcgttagcttgtctgctcctcgcctacttttctcacttcttgctgtcgagattactcgcttctgatgccctcatcaaactcaagcccagggagattggaatcatcttcgggattcctcgagaacacctccgctgtagggtatcctcttgaattcactcagactttttttctattagtgatcttttttttttgttttacgtgttctcctttcatttgcgatcgaaatgattcgctgttatataaaagtcgtgtcgtcgaacatcatcctccacccccatgagtcctctgcgtcttttttttttttaagtacatcagccaggccatcagtggctctatcgtcgagatcgcccacgatcagaaatctctcctccggccctacaagtcctctgctcatccatatatttttttaaccaccgtatttgttgtgcatgtggtgaacgtggtagatgacatatggtggataaagacactgttaatacagatatctctattttaatatatatatattaaatatattaaattataatatttttttgatatattattagtattaattttttttaatattttattttatgatatttataaatttacttatttttattttaattaattaattcattaaatctaattaaaaaaatatgaaactatcctccagcttgtcaccaacagaagttaggtcacctgtcaagctccatccaccgtgtcgcttgacccagagtcattcaaaaagaagcacattgctcgactgatcagacggcaaaagtcacctctaagtatagcagtggtctgatcagcttagccctttgcttcctcctagtgtcggtgggatttttttaatattatttttttaataaaatatttccaaaatagtatcattttgaaactatttccgaaagcatcgttattgtttgggccagcgtgcccaaatcatagcctcaaaacacgaatttattgccatggcagtcaaaattgtgggatgatcccatgattgcatgatgacctggctaagatcctgaccgtaaaaatgtgggacaggcccacgatttcaaaagctaaatcctggatcagacccttgatttttaggccaagtgaaatcgtgggtctgatccacgatttagcttttgaaatcatgggcctatcccacatttttacggctctcatttttttttttttcctcccgtgcattgcacggccagccttcatttttttcgctctgctctatcgagaagcccagatgaaaaggcatgggtggttgccagtgcttgtgcgaagccgcaagggctcagattcaccacggccaagagagagaaggggaggggacaatgacggatgggactgtgaaaggtacagggggcagttgcacggagtgtgggaggtgtacaggcacccaaaactgaggagaggaggaggaagaattggtggcgccgaagtcaggggagagggtttaatgatcgtgcggagctaggtgcaatgcgaacgataatggagtgggaagaagagaacggaagagggaaaaaaaatatatatatttgagagagaaaaaaatatattattattttattattattaataatttgaataataataaaatattattattttattaataataaaatattattattttttattaataataaaaatattattatttgattaataataaaatattattttagttaataaaatattattattttttgaatactaataaaatattattatttaattaataataattcgcttcattgccatggctgtctctagggctgagtacgggtcgggttgagaaaaaaatttgatacgactaaatccaattgagttgaaaaaaattcaatccgctgccaatcgtttatcatatataaattatttgaaaccgaagttaatgatttgcaatgggttcagatggattgtgttggtttgggcttcaatatctatccaatattgattttaaacatcacaaactaatacaccattcaatttatatagaaactaagatataataatttcataacatacataagttagtatataacatgtcataattgtcaattttcaattctccaaatagcctaagtattgaaaatactatatcggtcgatcggatttgatttcatatgacttaaaaatgcagaatcgaatccgaccataattaaccaaattttttatgaattataatctgattcaagttcggtttcatatggattcgatttcatatgagttagattggatggatttcttcaggttttgattatttgctcagccctagttgcctccctttcccgtacgggaggcctaggcaatgaccatccttccctttgcctctcccggcttcggcaaatccatgcccttccatcctccatccgtgctccctctgtcttccgtccgtgcctgtgccaactattagtgctctctcgcttgatcgattccaccacctacctccttgctcacccatggtgcccccgccaccatccaccaccccccccccccacccgcgcaatcaaaggagatagaaaagtctcgtagatccttcgcttacatattacccttttttatataatattttattttttaaaaataatattttttattattattttcatctcttctccctccgttacttttatttttttaaatatttttttaattttttaaaaatactactttattattatttaaaaataatattttaaaaataatattattattattattttaaaaataatattttttgaaacaatattttattattaattttttaaaatatattttagaaataatatgttcttgtacaaataatatttctaaattaataataaaaatattatttttaaatattatttttaaaaataatatttttattatttttttaaaattaattttttttctttcgctcctacggtttcaaattattaataataataaaataataatatttttttctcctttcttttatcctcccctcttcaaatactttctctttttttttccccctcccttcccttcctcccgccgccccctacctctccaccctcggcgatccgtggctacctcgtgaagcccagatcatggccatccgcatcacatccgtcgcgactccaccccaccgcgagatttggacacgctagcccaaacaatcgtattttcaaaaatagtttcagagcgaccccatttttgaaatattttattaaaaaataatattttaaaaaaaaatcccgtgtcagtgagttttcgaatccagatgcaagaaggcaaaccctgcttgattttctaccattggagcgagaatgatgcatgtccgtctcttcttcaaacgcgagtccaccaactccggaccccaggcccctctataaactctttttgaaacccaattcaagtccgatacatagacactcctctctctctccctactagtccgtcggccagccaactaatccgtacgtctttcctcaaaacccctaacggtggatttgtctcaagctgcgaagccaacggttggaaattcttctctcttgtaggcaacaaattccgggaggaggatggcaggagagatttcattggagggggaggagagggagcattttgggatgatttaaagcaaaaatagccagcttatcgtcttctatgcagagagaactccttataatccctctgctgctcctctcgctcttcgctggtcggtgggcttcactctgtcttctctttgttccaagtttcttcttcttttttcttttattttccaccaccgttctagagagtaaaggggctcaatgtttcccagatctctgccagcgcgtgctccggtgcccttccgactcccggcaatgctgccaccatccgctccagcatcggcaccgatcggacagtccagccccggggcagaaaggtgcctgtgagtgagaggatcccgaagcgaccgtgcagcgcaacgaccgcaccacccgcaacgggctgccgcagtgcaacgtcggccactgcaccggtgccgctgagcacacagacgccatgctggcagcggcatgcgaactgggccatgcagtcggcgatgtcgacactgccagcgacctccatcacatggctagggagggcattaggtctctcgcaggtgatgaagccacgggaagcggtcgagcaggaaaaaatattcgttgcaacggtgataccgcatcaaatttgtaacaaaccaatggcagcttttatagttcatcgattgccgtgtttactatcagctggattccactactcgcgtcttactgcttttgttgttacttgcttcaggacgacaaatgttataatggcattggtttatgctttggatgttcaaacgatggcttggcaaagtggtttgtacaccatacaaaaggtaggaggttggaaatattaaccattaatgcctgctgatgacttaatggatggctatttacttggaaaatcccaaacttgagaatataattaataatgacatagttttcatggttccgtaataacacattataattttggatcatttcggagtaaataatttccaaggccctcttgtaatttacaacttaaagtaactaaaatattttaaattataaaataatatattaaaatattaaaattataatcttcaaaataataatatttaataatatatcatgattttataaaattaaaaatattataaaaatgattacataaaaatataataacaatcataaaaagtaatatttataaatattataaaatttaagaaattcactaaaagtgcaaaattgattagaaaagtggtggtaattttacctctcacttcatgtttcccgctcatgataggataattgattgtgtcatatatctcatctattatgagacaattgataaatattacattttcagtatgtaatagaataattgataataatggtataatttagagctcgcatatattcattcaattatgctagcttcaattttattaatcgaaagcacccatttcgcttgccacatttaaggtaaaaattgtcatgctcatgcaaagggaagatatatgtttgaaaacataaatttttcaaagatatcagtgagggataacaagctctactattttccagaataaaattatagcacagctcctcattttctttccatttaatcagtctttcctttttttctcctgcctcataccaagcatagtcgttccttttttttttctttgcctcatatcaagtaagattcaaccattcatttatggttcttcaaccaacctcattaaatgaaattaagaatatgaaccccaaagacatgtatagcagatcacgcaaagccaatgtttaacatcaaacaccatcgcaaccaacacattaacagacctaaagccaacactattacatgatcaatttcaagcaaagccaacatgcactattgaatataatcaatggctgagtataacagcatgcaatgctcagggaacatcaagctagagagttggcaaagagagagtcttcacatattttatctctcgaaaaggcagcaatcagagggtattccgagtcgctacttaaatgcagcaagcaaggaagcaaaatgccaaagatggtatatgtcacaccccgaacccaatatccgggtcggatacgtgatggccgcacactccttagagcaagccctaaagaatatgcaagaccaaattaaatcattacaatctcatcaaccataatatttaatttcaataataattcataaaatcttgcataattataatttaaatttcttcaatttctgatcagatactatgacactctatttatccttctgctcacccgtaaatccaagccatagccaatctaagtcatcctgtaactctgagaagaaaaagaaagatgaagaggtgtgagcttttcagcccagtaagaatttccatatcacactgatataataatatagtctgaaaataaggataagcaataaaatataaaatctcatgttcaatgtccagaataatgcaaacattcataaattttctgtcttgttaaaatagatgcatcatcatatgttaacaggtgaaaccccttttattcaacaattatttcatatcttatctttcatttctcctttcataatcacatgatttttaacattttctttctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagttaaccttagatttatcttacaatcatttagataatttctaaatcaatcttcctttttaaaagaattaattctaacttgacaaactagaagaactcaagccagcatccttaattagaatcaacttgattatttcttatagatctctctttatcacaatccttaatattaatcaataaatccatacaaaatcttgtcccttgtataagtcattcaaaatttaacattagcaagatgtcttaatttaatttaaaaatccgaactttgacttgaataattaatacacttcaccatcttcaataatcacaaaaaaaaatctaatccaaaaatagtaatatgaattattaaaaaatttcatcataacctgtatatcattctctgacataatattattattatttttttttataatatcaaaatatttttgatctacttagaaaaataagcttttgacttgaaattcaatgtaacttgaaggatcaaggaatcctattcagaatatgatattttgagtaaccaaagatttcaccaagatgagtatctcgtattctcataataaaatttaagtatatatatatatattattttttttcatctaaattgagtttatatgacctcttatagattcaatgttcaaaaatatttctctctcatatgatgtaatttcttcttagatcataccctaattaactttctttaataagtccaaaattcataatgctcagacaattatcatcgaaattaaaaaaaattatcatgatcttcaatcatataagtttacattccaaaatcctctagtatacttaacatatcttatcaatacctcccactttattctaaggtcaactcttttcatatttaggtcaatcttactaattgaaatctaagatataactcgtcaattttattatagacatcatatgccacttatatataaatttcatcttaatatctattgatttgaaatctaaatattgaatcttctcttttatatctatcatgttcctcatgatcataacctaaattcagatgtcactagaattacaattctgaataattataaccttaaactcaaataccacttaaatcatattttctagtgatcataatctaaactctaatatcattctatcatacctttaatgatcaaaatcttaaactccgatattatcaatcatactctggtgattataatctcaaagttttgatatcacttatatgacaatccctagtgaccttaaacttgggctctagtactgttctgtcatatcctaatcacttgtatcattatctccaaatgaacataacctaagttctaagctcagatgccactctgtcacatcctattgatcttacataaagttttaatatctcttcataatctctggtgatcttaaatctgagctatgatattattctatcacatcctaatcatttatatcataatctccaatgttcaaacctaagctctgataccattctgtcacgccccgaacccaacacccgagtcggatacgtgatggccgcacactccttagagcaagccctaaagaatatgcaaggccaaattaaatcattacaatctcatcaaccataatatttaatttcaataataattcataaaaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgaggtccccccttggtggctcaggctccggcggcttggccggagatccggcaacgatggccgactgtgcgaagccggtcggcgatggggttcggccggcggctctctctcttttttttttcgaaaaataggggatcttctttgaaatttatttccagcaaaatcgatggccggcagtgaggtcttgggccaggagagaaagggaagagggagaagaagaaggggagggacttacctcgagctccggcagtcgagaagaactccggcaatcctttttttttttccatctaagaacccgcggatcctcttggaaaaatccctcaaatttcttaaaaatctctctaaaaccaattgcagagacatgagggaaggagggttttataggagagattttctacctctgatcggactctaccggtccgatttcatcgtaaacggagaggaagaagactccggttaggagtcttcctcctcctctattttttttttttaattctgggttattacagtatataaaaaaattggaattagcaagctgcaggatctcagttgaggcaatcggagttcctaccaactggaccggccaaccatcctcttccacgacctcccaaccaaaccacaacatgcatactccacttgcaataaaatcaatctagggtttagtcatcaaaccctaatgcatgactttagacaccttaagcaaacggtcagaaagaataagcaggcattaatttgttggactgactctaggttagggttgacggcaatgagagagggccagtggtccatcatggcctacgagatgggactcgatggcgatgggaggcatgatagacaaaatgtagcactgattggcgaagaccggctagatcaagacaagaaagcatcggagagtcaaaagataaagagcacagaggagtacacttttgggtgttttactgcattttgctcttctttataactgcaaattcattttgggttatatgggtctttattgaacaggtctttttttctccaagttaatacagcttcggcccttttcttgccaaaaaaaaaaacagagcacagaggagtaaagagggctcaatagaggagatggatgtgcatcaagtcattcgatggtaaagactggtgagatcaagatggagagtagttgtgtaggaatgcaaagatgagtaaaagagaagcaaaaagaatttaattttctcatggtgatctctccttcgccatttctcaatgcaactgattattgtgaaattttaattttcttatcttttattcaaaatcctaccagtcaaaaatctttgctttcttctccttttaaaagcataaacatgtgaaactagtttagaagttcccggcaataagttctcagctccttatttctcaccgatcttgaattccctaatacatgagaatacagatagattccttccccttgatgttgcctttgggaaagatattcttagagtaaacttgcagcaaatttcctttacgcaagttcctggacaagatttagttgaaaatctcttgtaaggaatgtgcgatgagtggagatcatggctacattttccaatttccttgtttagatggatttggaatgacgtcttcgagcccatgaactgtagttcgtccagtactttctatcagttgatcccatgttcattcatcttctgggaactcctcctagttctgagcagctgcagccagccctcgtaccaaagtaggatatatcatttccctcctgtcataatagagaagtagccatttctgcactcttctgtagaaggtacttaaagtaaatcttctttcctgcttgagattaagtccttgttatgattttttccttctaaacattttgaaatatgtttcctatatttgatgagaaaaggcttggacaacgactccaatgggctctatcaggatcattgctagatgtactcagtgatcctgtaaggttggccgtgctagatcttgtttaaacttattgtgtgcatatgttatgaatcctacactgttctagttgcttattatgttcacaatctttgtcttcaaccaataactagattcttcggagtggacaagcctccctgcccactaattcgccttttaatgctcctaaggatcctttatggactactttatgtcctctttcaaatcttcagtcatcccggatctacgccgaggacagcgattctcaaatatcgtagaacagaatgtgaagggcaaatactctttagtatctatttatttacttgtttgggcaaacatggacatataaactcttaacgctgcaacttccgcccttatctcaacctataaatatactttagcgatcagctatgcttgactcctgctcaggagaatccatttttctggcaagttttgattgatttccatatttgtcttcttgtaaatggttacgtcaatgatcgtttctctgttttcaattcattaaggagtacgtctcagattagtcatacaaatttgattgcttcctctggacaatagcatggtctgacccagcaggtgttatttttaaatatatttaatatttatttttattttttttgggtaaaacattatatctggttgatttggtctacaaaagatcagttactgtaagactgcaatagaacagttatctttgatgccatttcctttcccatataaagcgttacaagatttatgttcttaggaaaagctttgaggatttccttcaatacatgaaaggatttccagaatgaccggggtggggggtggttaaacattaagttaaaagtagagtgaaattgaaagaaatagcaatctcgatagatattttaaggttcagatgctttttggaagtgccttctctccctttttccttgacgcctttgatgagtggcaatggtggtgcatgagagaggagagaggaaaaggaaaagattaatatcgagtttgcaagtgaaatctcaggagaaggaagaaggcagaactaggggagggcaatgtagtggttgctagatctattcaaatcttgggcagctcgctagtctgtttgagcccagagtattttgaacgggcctaaacctgatttttaagactggcaagtcgggtcacgattgccacaagctccccatccccctctcaccgctgctgcggtctcccttccccctctcattgtcgttgccgcgggctccactcccctcctctcctcgccgtcgtagtctcccctcctcctctcgccgctgccgccatgggctcccctccccctttagtcgccaccacagtctcccctccccctcttgccaccgacattgccacggggctccccttcccctctcgccaccatcgcaggctcccctctccctctcgctaccgacgctgccatgggctccccttcccctctgctattgccacgatctctcgcccccctcttgttgccaccgccgcgagctcccctccccctctcgccgccaccgtgggttactctccccctctcaccccaggctctcttcccctttatgcatgctcttcaagctcccctccccctttgcgtgcccttcaagtgctgaccctgatgcagatttcttggttatttaagagcatcattgtctatgattcaaaaaagtcgggctcaagcctcgataattttcgttatgcattggattgagcccgggttgaaccaggcctggcccatctgataagcaagtctagtggtcataaatgagatcgaggtgaaggaagaaggcaactctagggtcacaaatgagatccaaagaggaggaagagggcaagtttggtcgcaggtaagatcgaaggaggaaaatgatagcattacatcataggtgagatccaaggaggagaaaaagggcagcatcaagtcgtgaatgagattcaaggaggaaaaagagggtgatgagagcataaataatgggcaattacagtgataacatcagcagggtcagaattgggctcagaccagatcgatttcaagacggatttcaggctaggtccgaaacagttcaggctagactcggacctaaatataaggcccatttatctttcggaccgagcttggatatatatttgatttagcccaggtccggcccaggctcaagcccaaaatctagcctgatagtagcccgaagtccatctaaatagcgtcagatgcacatggaccgtgccaaatcccacgatcaataacacgccatgttattccttgtatttcgccaattctcgattgcacgctatctactatgcatatgctctgcgatttgcactatgaccttatccagtccgagtcccaatcaagagcccctcttcgagaagcttctctctctgggctacctcttcttcctctgtggccttcgcgcagtggcaacctccaatcagagactctcccactcctctccctctctacgatctcgatctcctcctcatgctctcagatcacctttcatagctccgcttctcttttctcgtcatgccacagtagctgtcaggttcccctgctagctccgatggtgcgtcggtggtggtcaaatttgccatggagatggaataatccaggatcttctcgcctacaacctcatcgacgaccacagtgctattgtgtccatgtcttcatggctgtcctcctcgcccttgtcactgctctggcgataatctgaatctacgtcgctgtgcatggcagaagagatagaggaggggagaagagggcagacgatcggggaggatcacatgacatgggaggtggcgaagtcgtatgcaagttgagaaagagagagaggaaggagagagaaacaaagggagagggagaggcttcgggctaggtcttgggctcagaccttaaattttaaaatattttcgatcctaagcccaatctgaaatccaaaaaaaatattgcagaccgaacttggataggagtggggtctggcccagcccgacccatttccatccctaaacatcatagagggaggagaggaggaagtgacagtggctgccatcccctccacctttagcctctccttcccccctcttcttcctttgccaccattgtttgcaccccaacctacaacccattcccaccatgcaatctcccactttgccccttacggtatatgactgcttcaattccaaatggcacctcatgccacttctttgtccctcatcctcctctgcctaccatccccaccccgactctagcctgctcttcactgtgtaatctctccccctccctctatccccaataagtattacaacgacatcctctccgacaccaacctcgatcgtcaccatggacaactactccctcttcaccatgctcaccatggtcaagagcatgggcaccttcactccctctcgctccttgagaaagtccttctttctttcgcttcctccgacacctctattgccttctcctctccatcttcaatgccatcgctacctacatcttcaagaagaataaagctttagaaagatattaaaatatttcatttttgaaaaaaatgatacaaaagatgttagcaagagaaagagctgagcccaacttttgacttgatttggccaagttgaaatagaaaataaataaaatattttaaaaaacaagaaagtggagagggtgataacttgtagctaacctactcataacctattaaaaataaaatattctaaatacctaatttattggtctgtcttggtatctctcaattttttgtaaaatattataaaagagcactataaccaaatcctaatttcaagtgtagtgccggtaactcctaattagttgccataagtatatttttaattgatcttgacttttcaatttggggtttataagatggtgaatgaaaaattgccacatgcacctatttgatttgctaatctcattcaaataaaaataaaattaaaccttaatattattcacaaggtgaaaaatcatgcggttgtgtagttaatcctacattaattatcggtaggaagatcttgagtacttatatatacaaaactaagaaatctaaataataattttcgataagtctttgcggatgaggttttagattattacaaatgatatcagagtggatccagctgataatccatatagattagagaatattacaatatgaatttattgggactgaccatagaccgatcgtggcatttatgaatagacttacatggatttggatccttagcatagtgaggagaaattaatcagaaggagtacgtgaagatctatatgggcatatatgtagtcttatattgattatttgttggaaagattttagatacttatacagatcaaagaatccaaataataccttctaacagtcttgttgggggagattttgtattgttacactcaaccattttttttatttcaaattaagccagatatggttactgcaatgagaatgaaatcctctacggtactcaaaagcactgtggggtgctgtgcatggttggacatcattcgttataagacgaacagctgttcaaatatttttggggtttataaatccttttctttgtagtattctcatgagtatgtggctatccatcttatgatggatgaaatctaatgatttacggcatcctatggtattttttgaataccgcggatgatccgcaatgactgatatcaataatttcattttcattgttattgattcaattgacctctgcttggctctgatataggtcatggcgttgtcttccttggctcagtgcggattagaaatgggatctgaactagcaaacaacaccgtacagtcctcatggaaacatttgaagtcccgagcaggctatcttctacactacaaggagaaagttgagaaactgaaagaacgttttgagcatttaaagaatgtaagaaatgacataaatcgatctgttgagacagctaatagaggaggcgaagtgatcaaggacgtagtaactgcatggctaaagaaagtgaatgaactggagacagaagttgttaatatggagaaagaggttgaacagaacaagagatgtctcaaggggtgttctcccaactgtcgttggcgctatcaacttggcaaggaggctacaaagaaaaaggctgttgttgaggggcttcttgaagaaggaaactttgagagtgtatctcagcttcctcctccaccaaccattgagtccatgccggtgggtgattttatggccttcagctccactagaatcgctatggataatgttatgaatgcgatagaagatgagaataagcacttgattggaatatatggtatgggtggtgttggcaagacaaccctgatggaagagattggcagaagattgaaaaaagataagaagtttgatgctgttgtcaaagtggtcgtatcacagaatccaaacatagagcagataagacgtgacattgctgaggagttgggtatgacactctgggggagtggtgaatctgcagctagggcactggctgctaggttgggtaaggagaagaaaattgcgataatgctggatgacatatgggctaggttagagttaaaagacattggcattcctttcagagatgatcacaagggttgcaaaattttactaacttctcggaaatctgaagtatgtgatttgatggaaactgatgtttcggtcctagtagatgtgttgtcagaagaagattcgtgggaccttttcaaaagtaaggctggaaaggttgttgaaacctctgatgtagaaccggtcgcaaaaaaagttgcaaaggagtgtggtggtttgccgctggcaattgttgtagtcggaagggcattgcgaggatttaaggaaagaagtgtctgggatgatgcactgctccagctccaacaatccactcctgcaaacctagaaggtgtggaggaacagttgtacaagtcgctagaactgagctacaaacagttgaaaacagacgagatgaaagtgttgtttttgtactgctgcttgtttcgtgaggactatgacataagtgaggatgaacttacacgatatgcagtgggtgagggtctattgaaaggtgtatacgccttggaggacgtacgaagtagagtgcatttcttggttgagaaactgaaggcttcatgtttgctattaaccagtgataaaatggggtgtgttaagctgcatgatgtggtccgagatgtggctgtatacattgcatccaaagacgacaatcatttctttgtaaaagctggcttaggagtgagagattggccagagggtgaaaactgggaagcatgtaagagaatttcactgatgaataatgacctacaggcactacctgatcggccaaattgccccagggtcgcgactctattgttgaacataaatcctattacaactggaataccgagcaatttctttcaaaggatggcagcacttaaggttttagatttgagtgacactgatattgaatcattacctttgtcactagcacacttgacaaacctagtgacacttcgtctggatagatgccaaaaattacaagatattacaatggttgagaaattaaagaaacttgaaatacttggcttgcagaaatgccgtgttagtgtgttgccagaagaaataggaaccttggtcaatctaaagctcctggatatatcaaactgcagtgctcttaggataccacctaatttgatatctaagctaagtcggttggaagaactgtacatgataggctgcaatgccaacaaagatctccttgctgagattgctttcttgaaacgcttggtcagattacatgtgtatgtaagggatgccaaaaacttttctcaagattctctccccgtcaatgcttgggagaacttaagccacttcattgtttacaatgaatttgattggttttctctggcttctctgcaccgaagaaatttttatctcaagggagtaagcaactcattgaattgggctaaggtattgttgggcaaaactgaggacctcatattagatgactggcagtgggatattgtgaatttggtgaaattagatgaacaaaatggttttgcagacctgaagaaactacgcattacaagatgtcatcgcatagtgtgtcttcttgatacaacaaaagtggctccttccaatgcatatcgtgacctagagattataaacctttggaatttggagaatttgaatagaatctgccagggaccacttccagctctatcatttggaaaagtcagaatcttggatataatgcgctgcaagaagttaaataatatatttccatctgacttgctgcaaagagtgcattgctgtctagaagagcttgccgtcaaagaatgcgacgaaccacaggtggtattcaattttgagggacttcagcaagggagtattatgctgccaaatttgagtaaattgacactgcagctattaccaaatctaaccaccatctggactggagtcgtttctcaaggaagcttgcagaagctgagcactctggaagtgtttagctgtaacaaacttgcatatatgttctcacgtcagtcggatactggacatcaaagactgctaccatctgggaccttcatgaatttaaaagagcttaaaatatcaaggtgtaggggcttgagctctctcttcttgccaagcatagtgcatgagctccggagattggaaagattggagctcaaagacaatgaagcaatggagaagatagttgcagaggagaatggtgttcggctggagaaaggagcattccccctactgaaggatctgttactgataaacttgtccaagttgagtagcttctatggtggggaatcagcagcaatatttctcgattggccttcactgaaatacatcaagctggggggctgtccaaatttgaagaggctcccaattggaccagagagtgcaacgaagctaaagaaggtgcatgtagcaggcgatgatgacattgaatggttccaaaatttgtaagtgggaaaatgcaagcatcccttcccgctttcgtatctggtaagtcttttgccaagcgtttccttggtttcatgcgtgcttccttcgcaaattgttctctagtattttaatctagtgtcttctccataaaaaaattcaaaaaagaaatcttactccagcgcatggatactggattacctactgcagcctcagttcctggagtctccttcgaccggtggtatagcactacctatgacacagtttttggccctaccatatgatacatttttttgcaccggtagattgccttcaatggtcataggacatccctgcaatgggatgaataaccaccttacaattatagatcagcattcaaggactcaccttacaagttttcaattggaagttgttgtgtggacttaattgacacgcaaggtgaatccttttctcgaaattttgctgtagaactaccccaatttgttgttgggtctgcctcacacatttgaattggaattttcacagcccaaattcaaattgacctttagtgcactatctcttcatgctcagccaagtccgctatactggtaagctattcaaggcctaagttggcctacctattcccaagcctggattgcctttgcaaaacctgaagcctctcccttagctacaagtttaaggcactaaagagttcattaagctactatccctgtctgcgaaacctgctgtaccttccagtgcagcttcgtttcagtctaaccaacagtgtgcggtaaaggagcagaaaggcagtttggttattgggtgctctgttttgcctctccgaaatttgtttcatagtggctaacacaaaattatgctaaaaacagcaaatcaggcaccgaaacagattcagattaggcatagacgactgtgcagtttgctgttttcaagtgcaagctgagagagatggtgctgaatgcaatcagttgactctccatagtgttcggaatgtcttgcttctattacttatttcttatgccttgtcatgggggcataaaaatgttttgtattcctgttgatttgaaacaaataatgtgctctgtaagttttaacaattcagatatccatcttgccgttgtttgattgtacattttattttggactatttcactccaaaagttttattctagactctctagaccagccaaaatcatattccttaactgattaaaattttttgtttgttcaatactttcctccagactccacagttgtaaggatttcaccattgtgacgtctgggtctctaaaaatcctgaaaggggttaaaatacttttgtatcaagtatgcggatgctagtgtaccaaacattcggaggaccgctagatatgcaatttgagtgcagatgaaactcgcctacctattgtgctttgtcatgcaagacgatgggggatcaccaatgttgagacaaatcgactgatccccaaatatcgatcaatctccaatcaaattcgaccaacatccgactctgtccaccaaacagacggacgaccctgaaagcgactaccaactgagtttcgaccaagcaggcagaccgatcgtcttcatgaccgactcaccgtggctgacttaccatcttcatggccgaccgaccatcttcatggccgactcattatggccgacttatcatcttcatggccaactcatcatggcccgacttaccatcttcatggccgactaactatcttcatgacctactatcaaacggccgactgccaaatatataaacacaataccataactgtcacagacgattattagtcgcatatcgtggcgcaattagtgaggattaacaagccacacgtaattatgacccgatgatttagcgccataaaatgtaggaccacgtccgacggttataacaatctcatctataaaaggagataagacaacagtatcggtaagtcacttttggtctgagctctgctactcaaattattcaaacttactattgcccagtctccctttctgacttaagcatcggagggtccccatcggaggcaactccgatcagcgtggactttgttttgcaggtactcgtttccgacgaacaaacgatgagggaattgaccgcaacagattggcgtgccaagaaggagagaaaataactcgtaatgacaaaaattagagctcaacgatcaacagcaatcggatcgacgggacactctttccatcgggaagaggctcctctcctccctccgatagcagagcccagttcttcgcgctccatgctcaccacggacatccagattgctgcaattattcagcaaataaatattttcacagaggcggtcaaaagccttcagcagtagtagacccagccactacagccatcggcgaaacaaccgatggcgtattcagtgccttccaggcacagccgccatcacctgcggcgaacttcattttttccaccaaagcgaccgtctcgactctctcagcgggatgagcagcggtacttgaggtgctctcgacgtgccacccaccattcacggcatccctctcctttccaattggatcgggcaagaaaaggaaaatgaccgcaaacaccgtctacctctccttctaattcatcgggaggttcaacctctggagtctaccaccaccagcggctcgacgactataaacgtaagttcgagaaaatcgaccgccaacttgcccagcttcaaatggacggtcagaagtcttcaaatgacttcaattttcatgccatccaacctctcttctgacttatcttggatgaactaatcccaacttggttcaagatgccgcatgtggagctctattacggttctactgatccaattgatcaccttgagagctacaaggctcttataacgatctggggggcaactaacaccctcctatgcatcggcttcccgactacacttcgaaaggctgctcgggcctggtactccgaacttcgattgggaagcattcactcattcggacagctggaacatcccttcgtggcccacttcagcactagtcgaaggccaccacgaacctcggatggtctcttctcgatcaagcagcgagagaccgaaatacttcgggatttcgtggcccaattcaatgtggccacacttgaggtcagggacctcaacgaagacatgaccatcttggccatgaaagggatgtctgaggggatctcgattcacgtactctttggataagaccctcctccaaacttatgccgaacttctggagcgtgcctacaagtatatacgcgcggacgaaggagattctgaccgacgccaaacagaaggtaaggatcagaagatgaagaaacaaaagaagggagaagctccgaccgaatcaagttggccaccttccaataagcgagcttcacctcaacgatggagtccaaggacgaactacgacaggtatgactcctatactcctctctctctgctcctcgtgcacagatcctcctaaagatcgaaggagcaggatatctacgacaaaccccaacgatgaaagcgccaccgagaagccacgatcgaaaaaaatactgtcagttccaaagtgatcatgatcacgataccgaatagtgcgtccaacttagggatgagatagaggttctgatttgacgagactatctcgaaaagtatcggagagatccgtcggatcaacctcctaccgatcaacaaccttagccgcagactgaggaagttataaataatcagccgactgcaaagatgatcaacataatcttcaaatgactgaactgagggataactcccgaagaaaagtcggagaaacgacaacaactcaatgtaataactttcttggaagaagatgttcggagaattcaaactcctcacgacgatgctgttgttgttctgacaattagttaataaaagcacgatggatgttttgttctactcgacttccttccgaatgcaactacttgaaaaatttaatatattgcatcactctttaagttcaaccgactattaaatgatgggtagtcaattcctgtcaacatcaatatttcgattttcactgtaaaagccagaagatcgactatctcgactccgaatatacttcgactttcactataaaagtcagaagatcgactatctagacacctactatatttcggttttcactataaaagtcagaaaatcgactatttcgataccgaacatgtttcggctttcactgtaaaaaccaaataatcgactttatctcggcacagaatatatttcgctttcactgtaaaagccaaaaaattgactatctcggtgtagaatatatttcggctttcactgtaaaagccagagaactgacctatcgactacaactgaaggccagcgttggcgacgcagactttctccacaaaaattgtgctgccctcatagttggctgtccatcgaagcagctagctaatttgccgacttagtaccagctaacaaaggcaaaatgccaagacgaccaaggtcggattggaatcatactgacttggtcacggccagtcgaaggatattcagcttgccaccgtttatcataacaatacgatgtataagctcgatcaagatccggacaatagatatccgacttgccatcattatcctaactaaatacgtcgaaaactacatgactagcagatttcgaagtctgcgaaatagtcggatctataatttataagccagaattaaaacgcatgatgccagttcgacgtataagtccgatcaagatccagaaaatagatatccgagttgctatcattatcctaactaaatacgtaggaaactacatgactagcagattctgaagtctgcgaaatagtcgaatctacagtttacaagccagaattaaaacgcatgatgccagttcgtcttcccgatgtaatggccagcgccgactcaccttccgcaaacgatacctgacaccagatctccctgctgatatgacagctcaaggacgataaagtagataatagaccgtattccgaagaatgtagcggcagagtcgagactcaacataacagataacaactcatttcgtccaaagcaactgaccatgtggctacgcacgcgacaactcaccattggactcaggagtgagggggcaactattgggacaaaccgactaacccccaaatatcgaccaatctctagccaaatccgaccaacacccgactctgtccaccaaatagacggacgaccctgaaagtgactaccgactgagtttcgaccaagcaggctgaccgatcgtcttcatggcggactcactgtggccgacttaccgtcttcatgatcgactcaccatggccgacttaccatcttcatggccgatcgaccgtcttcatggccgatcgaccgtcttcatggccgatcgaccgtcttcatgaccgactcaccatagccgacttatcatcttcatggccgactcatcatggcccaacttatcatcttcatggccgactgactatcttcatgaccaactgtcaaatggccgactgccaaatatataaatacgataccataaccgtcacaggtggttattagtcgcatatcgcggcgtaattagtggagattaacaatctacacgcaattatggcctgatgatttagcatcataaaatacgggaccacgtccgacgattataacaatctcatctataaaaggaggtaaagcaatagcatcgataagctacttttggtctgagttctgctactcaaatcattcaaatttactgttgcccagtctccctctctgacttaagatcggagggtctccaccgaaggcaactccgatcagcgtgaattttattttgtagatgctcattcccgacgaatagacgatgaaagaattgaccgcaacaactaagaagagtggaaaggaagaatgcattgtagcattgtgtgcacacccgcacgtgtgtatgtgtgtctgtatatatttgccaaataattctttcaaaagggcgataatataggagcaaaataaaattagaacaacggaagctttctttcctcaaagaaagtcttttgttaagaaaaatgaggaaaggggctgaaatgagaaagaaagatgctctctatctcaatctctctcgttcgtgtgagcgcaactgattggatgtgctatggatacaattgaactgcaatgaaactgctaacagcataccacgtgcgtgcttggctggacaggcggacggaagtcactattccaaagtatacttcggcctaacccaactctttcggcccgtgaaagtgaggagccgaacccgatattccctcgttgttaccttcaaccaggttgttccaaggactcgtttagttcgttaaaaataataataataataataataataataataatatatatacatatatatatatatatatatatatattataaaaaaccacctcttccccaaatataagatatattagattagatttctcgccatatatccgattgctgttgagggctacaatatatccgattgctgttgatggactataattacatcacatcatctatgatattcttttaaaaaaaaaaaaattgtgcacatattcgtataccgtgtatggtgatggactcacgcttttatccgcaccgctgcccaatcccgtgcgtgcgcgaatcatccgcaccgacgcgcacggtgcacaaagaatttctcccttgcgaggggcatagaaaggtctaacctactcccgagggcaaataacatggttttggaggggactcaaaaaacgttgattagttggataacaaatccaatggcccgggttgattgcgttcatccacttcaagcatgtctagaggctacttccacccttataatagctaatatataagcaataataagatcatggccgtccattccgccgggaattgccaggctggcaccgctcaaggagacgatacatgtcccggctataaaagcccgcctaaacagcttgctttgggactctacggcttcaccagcaccaccctgctctgccccataaaaggccgtatcagctctccgcgctgggaaaacggtgacgggctagggtttctcctcccccttgggcgaaagctagggttcctctgtttcgactgcaaaagctacgccattccaagaaaatttgaggattcttgtcctccgagtctcttccagaggagttcgccgatgcttcaaagatctttagggtgataggaaagaacgcttactttcctacatggcgaggtctggggtagttctttttctctgatatcttggttaaccgtatctcctgcgaatttttcttgatgttgattccccgcaactgtacctaaagattgtctcttttccgcttctttgaaagattttgttcataattctttcatgtttctttccttcttttaaattttcctttgttgttggccctgttctccgatctcatggttaagcttgtctgttgcgaagttttcctgacattgattccctcaaaactgtacctaaagattgccttttgtccgcttatttgaaagattttggtcatatttctttcatgtttctttctttcttttacatttctttcatttattactagcgctgagatcttcccacccaccccccgccctccacaaaaagaaaaagaatctttacgttgagatcgtccaatcaatcctataagttgcttcttttttggatgatttcgctcatgtgtctttcatggtcttgcttccgtacatgttgccttttcttttcccccttaacgatcatttcaattgctgtgatcttttgccttcttttacgttttcctttattactaacgttgtgattttttgcctcttcttccgatctatcctaaagatttcttcttttttggatgatttctttcatgcacctttaatattcttttctttcctacgttttgctttgctttttctcccttaacgaccacatttttttttaatcgctgtgatcttttgcacgaatgacattaagtacctcggattaatcataaagatggcttctgtttcacttttttcaatgatttgctaatttctttaatatgttaatgattttttaagtacgttgtatttgggtatgaataacagaaaatattcccaaacaaactagattaaatgaacaccttcagagtaatctaaaattggcttcttttttgagttactggaatgatgttaacatgtctttcactctttctttctttcttttccttaaatgtcaaccatatgagctctgtgatcctcttaatttttgtcctgtgtttatggtatctatcaatattgatagaggagattatatgcaatgaagatctttcaaatgtaaagtctactgattactcctccatgtagcttttttttcatttcattgactgttgtttgtagatatttcatcttttttcgtcctttcacaccctttttttttattttaattttttatgtccaccatatgagcacccctcatgcttgcattaagagaatatagcaataaggtctgggtaagaatatctgctgaataatgctaaacttgtctctttacttctgtgaatgatatttgcttttcttttgcacttctatgaatggcattcgtataactttcatgcttctttcattacttttttttttttaaaataatgctaagatttttgcacattaatagtcctaagatggggatataactctcaatcatttgataagtatgaccaagattaggtcagtaaaataaccactggtatggtacagtagttgccagtggcttataatttgaaagtaactatgtatggtatgattgttgctgatggcttatgattctgaacaaaacttataatttgaaagtaaccataagtatggtactattattgctgatagcttatgattctgaacaaaatctgagacaaaattagttggatgaatttatactaaacatctttcataaatcccactatagagattttttaatcaaattcattgatttaatttgatccgaagcaattgatccacactggggcaaccaaactatgctcccatgcttcatggtttcttaaaatcttgatttatatacaactataatttaggattacgtatttgttatgcaaattaaaacttcactggaaattttactagacattatacccattggggaatgactccagtgaacatttctggtggatatctctccctgctagagatgccttggccaatcatagatgatcattgttaggatgcgtggtagtcatgaaatttttcttaacttgattcatcatgcacttaagtcctaaattggcggaaacaaaagagcaagaaatcagtgaataagtttaaatatagatataaagataactttctatctactagacatcaaatttattgttttgacaaattttggtgttagagaacccccaatagtaataggcatcatacttccaaatcagtttttgtgggatatgtacaaatgaaatttatcatggcgttgcagctttagacgatgacatttgctctagctatattgtcaagatcagaatttttggaaattatcaatttacaaatccacaatatgcatgtgttatattatagctgagagtgctgagttggatatatatatatatatatatatatatatattgtaaacttatggtgtatatgagatgagtacatgagtaatggcaaagataatgaagactctacttgtgcggtgattcgatttgtattggtacagttaggcagatgatgctgtgtaaaatatagatggaacttgcaaagaggagttgaaagttgaccatctgaaagagttgaaagaaaaggctttttggttatcatcatatgtacttgaaaaacatcattagtggaattgtggaaaggaatatctaacataaaaatgctaattgcaaatattttcatcgaacctaaggtttatagattcatcttcagttcatcagaattttttggatgcatgcacatatattcttttgattattacattatggttgcatgtagttttcatgctaatttgctgacatatgcattgtaatatatttggtcacctgctttatatgtatgtgaatggttgttattatcttacatgagatgaggatcactgattctttgtaaaagtggccatggattagcatcctaagaatataagttgttttaggtgaagattgggctcttaattcctgttcgaaggaaccttttggtagattactcattcttgaatatactgatttttcagggatgtaatgttattgtccgcaatgaccatgctatatctgacaagagagttagccgcaagcatgtcagtttgcatacaacagtttatgactccgctaaagttgttgtgtcttctatttatgtagtatgttagcttaaattgcttctttgcctctatgacttgcaatgagaaaaatttggcggtccagctacattttataattatgacccaactataggttgcaatgtgcggcatataatttgtaacacattgtatcactctaccagagcttatttttctgatacttgtgtctatttgctaactatttgctatttcatttaccttatatttaatatcttaatatttcaaatgaccttgcaggaaggaccgaatcctgttatcgtaaaatctgggaatcaaagcaagaagctctccactcaggacaaagctctgattgttcatggtgacattattgatttgattcctggtgattatttagttaagtatgtaacctgtcggcaatgagcatgcatcttcatcaaaaacagattcaatcttgttacgaaaagaaaaaagacatattgaagaggagagttcagctgtcaaaaggaatcgacatattgttgaagatgaaactttggaaagagccttgcaggttttgttctaactgctttgctgacatgcgtccatgttttggcaaaatggcaatcattctattcatttttgaattattaaacttttttccaactcatgatggttttttggttcatttttcatgatgctgctgttgttgtttctgagggatgaaattaaatatcataatctgatattgtctagactcttcctctacattcatatatgaataattttacccttgtaaaaatgaaaagattctagctgaatttttagatgaaaaaagatggaaggataagctctaaatgaaatctactgggttatctcaattaggaaacatgcaagccttgcctattgacaatttgatcaaattgtacgagtgtttttttctttttcaactctggtggttatattatatttagatatatcaataaagaactggaatcccgtggcttaccgatgtatctttggttcacttattgtatatggtctggactggagtcttttctcatggaagctcacagaagctgaacactctggaagtgtctagttgtaacaaacttgcatatctgttctcatgtcggttggataccagacaccaaagactgctaccacctgggaccttcactaatctaaaagagcttaaaatatcatggtgtaggggcttgagctatctcttcttgccaagcatagagcatgaactccagagattggaaagattggagctcaaagataatgaagcaatggaggagctagttgccgaggagaatggtgttgagctggagaaaggagcattccccccactgaaggatctgttactgataaatttgtccaagttgactagcttctataggggagccagcagcaatatttcttagtcggccttcactgaaatggatcatgctgggggactgtccaagtttgaagagggtcccaattggcccagaaaatgcaccaaagctaaagaaggtgcatgtagcaggacatgatgttgaaaggttccaaaatatggtgtgggaagatgcaacatcccttcctgcttttgtatctggtaagtctttttccatgtgcttcttttgtttcatgtgtgcttcctttgcaaattgttctctagtatttactccagcatcttctcaaaaaaaaaaaaaaaaggaaaaatcttactccattgcatggatgctggattacctactgcagcctcagtttctggagtctcctaggaccagtgtatggcactgcctcttgccgctaccatatcatacattttttggcacctgtagtttgccttcactggtcgtagggcatccctacaatgggatgagtaacatgtttatcgggatatttttgattttatagtggtacaattgcaaatcagcattcaaggacttaccttaaaatttcatttggaaattgttgtctgcttatttgacatgcaaggtgaatcctttttttgaagttttgctgtggaactacctcaagttgtttttgggtctgtctgccttacacatttgaatttgaattttcacagcccaaattcagattgcccttaagggcactatcttttcatgctcaaccgagttgactatactggtaaacttttcgaggcctaagctggcctatctattccctggcctggattggctctgcaaaacctgaagccactcccttagctgcaattcaatggcactaaagagttcattaagctgcaattcctatgtgcacaacctgctggatcttccagtgcagctttgtttcaatctaaccaacggtgtgcagtctattatagaatgcagcaaaaggaagtttggtattgggtgctctgtttttgctttctgaaatttgttttttagtggctaacacaaaattatgataaaaacagcaaatcagatgctgaaagagattcagattagacggacgactgtggggtatgctgttttcaggtgcaagcttggggaaatggtgcttaatgtggtcagttgactgtccatagtgcttggaatgtcttgtttatattgcttattcttatgcagtgtcatgcaagcataataatgttttgtattagtgatatgcaacaaataatgtgttttgtaagttgtaacaattcggatatccatcaacttgttgtttgattataccttttattttggactatttcactccaaaagttttcttctggactgctttagatgagccaaaatcatattctgtaactgttttttttttttttccaattcttctccacttttcttctgggtttcaactaacactcaccttgcccctctctatatccccactcctgatgccccctctcctcgtgcctccctttgttatcgagttctctgatgagcttcccatcaacaccgacctggccgatgacctcagctctcttgctggtgccttccttgaccttaattggcttcagctcctcctccttgaccagatcaagtagtagatggcgggcagtaggccctggtggccactgctgcacatcgattttctgtcttctttgcccatccttgtgcttttatcattgtttttctccattgaggtaagttctttggccatgctttcgttaattttgtgcattcatatgtatttaaatgtctgattagccatcgatggctgatctatagatccatggttttgtccctagcatcagaactagggtttatgtggatgccagcagaatttttatggtttcttggtttgattcaccaatattgggtgctggattacgaataaatattgtgtatctatatggatgatccatctgtgtgctgttgttttggtttccagctataatctgaactttagttttgcttttgatggtctctcagcttttttgtacattgtgagttagcatgttttattcctgtgttaaatggcaaattctgtcactgttgtggagagtggggtccttgggacctagctgtgggcaaccatccctctctttttcttgtgctgtcttatttcagttggggtgagtgagtgagaggaccactaagttgacttttgtttcttctgtttctttttttcgtttgttttgagggatagctccctgctatctctctcttattccgtatcatttcattcctttcaatgaaatagtggtgaccctagtcacccttcctcaaaaaaggtatggatcattctaggtgttttgttagaaaattaagggattgttatatctttgtacatctatggaggacttgcaaagacaccccctttccagccatactctgcaatacagccttacaggattgcgatttatatatataaattaaagaactaacgttttactgttagttttttggataagtcagttcgatggtggtactttcttatcatgtgctattagtagtgcttttacttcttggctgtatgaagtttcccattctccttagtgctttagttggtatccgtttgcaatagtatttatattttatcacaggcttttgcatatacccaagaatatgacttgttgcataattaccttttgaaaatcactttttatatgtatacacctcgaatcatcatgtcgtagatttgtggctgataatgttaataataaacattttaagtatcatttgatgctaattattttatgttaacacccctgaaaaattaacatttagttttttttgaaaagagcttatttttatatggattttcaaagatattaatggaaaagagtagtaaagtcacttttttatacttagaacagttagttattaataccatcagtcaaaaatctaagtggaggggcattcatggaacaacaatttgatttaagcagtatactttcaaattgtgattttcaaaggttaaatatgcaataagctatatttgcaagggtgtatatacaaaaaataaaatcctttatttaatgcttaatgatttaatttatatgtttgtccacgtgtgcatatccatcaagatatatcatattgaagcatgcactatataaattttcatttatgggttcagtaactgatggctatgtggaatgtcgagttattgtgtaggtatgatttgtgttttctcatgtgatcgtttatgattctttgtcgatactttggactctgttctccttaaattcataggcctttatcatgtgtagctgacttatgattggaagtggcttagtgccaagaagttatggatctatgaatgttttattatgaatcgcttagaatttatataggtggttctctctatgaatttatatggattgactgatggaagatttttatggatgcttttatttgaaatgactcacctttgtaatgctactggtatgccagcactatgaggcggttgcaaattagatggccagttcggtggcaacctttgcaacccctaattcgtgtggagggatgattagagtggcttcgagaggaagccacatggaggaattaccatgtacttttcctttttccgtgccgctaatgtcatgagcccttatactctgagacaatgattattttcaatcccgcactatgtgccaaatgttgcaatgttttcatgttttattcattgcctgattgttttattctgccgtttgatggtactaggatggttttcacatgggtgtgttctaagtttgatttttttttttgttgctagttgttattactgtgtcacttgtttctacatgtgcttgtcctggttggattttatcacttattcactggtccctgtatatctttgttatatctgtgtatgtggtgttccaatcacataaccctggggagttcgtctcttcacccttgccatgttaactaaaaggcctatcaagttggatgccactacttcacgtgtccgactgccttgtttgttacttgttttcaggacgacaaatgtgagaatggcacgggtttatttttgcatgttcatgcgatggcttttatgcaaggcaaagagctttgtatgctatatgtgatgataaattttattatattatataagaaaagcctgggatatttggttatgattgagaaagtttaggaaattttttattttaaaaaggtagaaggtagggaatattaatcattaatgtctgctcatgacttaatgaatggctatttactttgaaattccaagcttgagaaaataatcaataatgaaatagttttcatggttttgtgataacacattgtaattttgaattatttcatggtaaattgttttccaaggccctcctgtaaattacaacttaaagtaattaaaatattttaaattataaaataatgtatttaaatattataatttggatttcaaaaactaattgtagtgcaatgattttatataaatattagaaataatgattacataaaaatataataacaatcattaataaaattgataattatgaatattataaaaatttaagaaattcgtggaagggtaaaaattcatgtttttagcttgtgatagagtgattgatggcgtcatgtttctcatctgtaattagacaatcgacaatattctatttccatcctgtcactaagcaattgataataatggaaataatttagagcttttaatattcattcatctatgctagcgtaaattttattaatcaaaagcacctggcatgcttactacattaaagttaaaatactatcattctctatgcaaattcaaagtatgatattacagatgcatgtctcaaaaattaaagctgcttttggttagccattaaaaatatatttttttatttttaattttaaaataaaattaaaaataatgtttgataacatcatgaaaagtaaaaagtaaaaatcaaaaaaattaaaataattattttatatgtaaagtaaaaatattttatttttaaaattttattttttatttttttatttttttatatttaaaatgtcaaatcaaaaaataaagagttcgaatttgatttccgctctttcatcttttcattttgtttttaaaatcattctttctcatcgagttcttcatttgtcattattttttactttataataacggtgttatcaaacatattttttattttttatttttatttaaaaataaaattaaaaatatttttaaaattaaaatcaaaaagtgtaaccaaatgcattttgaaaaatttttcattgatatctggagagatgaaatatgaaattttccaaaataaaattgttacttgtcttctgatttttctttctgtttgagcattgtttttatttttttctggttccccatagctcttcaactaacctcatcaaataaataaactttacctcatatatatatatatatatatatatatatatatatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntactatatatatatatatatatatatatatatatatatatagaacaagagccccaaagaggtaagtttaacatcaaacaccatctcaaccaacacatataacggtctcctaaagccaacactgctgcattttctgctatcaagcaaagtcaacatgcgctgtgggatatacttgactgctgactataaaaagcattgcttgctggggtacatcaaactagacaaccagcaaaaagagaggtttcacgtattttatctctcaaaagacaggaacccttgggaatgtggaggcggtgattaaatacagcaagcaatgagacctttgatcaagcatatacccttagtgagaagcaggacctcaattgaggcgatcaatgagacctttgatcaagcatatacccttagtgagaagcaggacctcaattgaggcgatcaatgagacctttgatcaagcatatacccttagtgagaagcaggacctcaattgaggcaatcagagtccctagcaaccagatcagccaacctcccaaccaagccatgacatacatactccacttgcagcaaaatcaatttagggtttagtcatcaaaccttagagcatgacaacaatcaagaaggggaagagatatttccaagggcgacaagacccaccttagcaaacggttagggagaagaactgggtgagatgggtataagtgggcgagatgggtacaagcggataaagattaagagggaggaggacagaggaaggtttgatggtgttaatgtgctaggctgatcctagattagggttgatggtagcaagagagaatcagtggtcatcatggcttgagagaagggattggatggatggcgaagaccgtctaaatcaagaaaagaaagtattggagagtccaagataaaatgcatagaagagtgaaaagggctcggcaaaggagacgacatggatcaagccctttgatggtgaagataggtgagatcaagatgaagagcagttaggtaggcgaggaagatagagacaactaaaagaggatttaattttttcatgatgatctctcctttgccatttctcaatgctactgatcattgcaaaaattaaatttttttatttttcattcaaaattctatcaatcaaaaatctttgctttcttctctctttttcttttcttttcttttcttttcttttcttttcttttttttttttttttgtgaacttgctttcttctcctttaaaagctagacttgtggaggtcctcccctctttgattgatgaagctcgatcaacttttataaatgggagaactatggaaacttcctttgtgctcatgagatggtctggtcaggaaggtgtataatgcaagcttgactttggaaaacatttgacaaactgaattggtgctttttgttggatgttctgaaggctaggggagtttcctcaagatggattgggtggataaaaagtcttctcaattcggcttcagttgctctcttggtaaatggaagacctggcaattggattagatgtctgaagggattgggacaaagggattctttatcattagaattttttttatcttagctactgacgtgctttccaaaatcctacttccaactagcactcttggactcattgaaggcattaggtccaacatggtcttcgcaagcattaaaggattgctttttgtagataatactcttttattttgtgtgagcaagaaggatagtgtcctggttgcaaaagctttactcttggttgttgaaagagcttctgactcgagaatcaacttccataagagtcttacaatttgcatgaacatgaatgatggtgaggcgacatcctttgggctcttgatgaattgcaataacggttctcttcctctcacctatctaggcctcccactgtgtgattgaaagtttcctaggcattgttggccaccgctctgggaagtatccactcaagattgggttcatggaaagaaaaactgctttcttagggtggaagactcaccttggtgaactcagtactttctgctcttcatttctactacatgtctatttttaaatcgctcaaatgggtcattgacaagattgatcaggtgcattatgcttttatttggaaggataaagaagagacccgtggttttcattgccttgtgaactggatcacagtctgctgatcaaaggaacagggaggattgggaattagaaacctttaggagacaaattgcactctactagcgaaatgggcatgaacatttacttcaagtagtgatactccttggaggagattaaaaaaaaaaggccaattatgtgcagaccaattttggcatgcaagacatctgtaaacagatcactgcattctggcactatcttacctctaatttggggaatggagattctatcagattttgagaagataattggtgtggaccggtgccattttgttccatcttctgcgacctttactaattggcattggaaaggagttttccagttgcttctcaatggtcatggcggtccctgtcttggagtatcaaactcaaaggcccactcttgttggatcaattgagacaattggaggtcctccattgtagtctggcccgtgttaaactctctcgggttgcgagtgcacccgcatggaaacttaacaagaatggtgctctctctttcaattccttctacaggttcatcaacaatggcagcatcttgtccctagggtaaggtaatttggaggtcggaagttccagaaaaggtcaagtgtgatagcccagccagcccaaacgaaaaaaaaaagagagaaacaggggatcgggaagaagactcccagtaagagtcttcttctccgatcaaacctcggagaacggagtcctaggaccaccaggagtcctagggctctctataaagagacctcccccttcctaagagatccctcaccggtctttttccctcttttcctcccaaattcctccgattgaagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaattttcaccaatagatttcaaatcatttgttctaccaaatgatactatcaaatcaggattttaatgaaattatgattttgcctttgaagagcataaggactttttcattttacaattatttgtatcccttcaatctgctttgtaatcatcaaaatcaatctaggagcaataattatcgaattgaattgatatgagaactaagatttaattcatattgattatagtaaatctatatgatggtttaaatatgatattggactcaagggttaatcaagattattgtacaccagtaaaggtataaatgagaatcgaaagttaatctttgatttcaattgaaatttaaaattttagatcttttctattgataaggtaaaaaaataatttgatcaaacttttttttggtgaacctaagaaattttgattgttagatcagagtgcgcagcggaagcatgataatctggattactttgagtaagtcaggaatgctgattctttgagtcaaagaattatgataaatgatatagtttgatacaagaaattcatggatattagaaagaataatattttaaaattttgaattattttagatatcctaatgtgatttttaaaagtagagcttccacctactatgctacaaaaataattagcatcctaattctaggatgagtggacctttgatttttgattttagatttagaatatttagagataagttttctctatcctagaattaaattttataattccttatttattaggaagaatttgagattgtttatcgaatgatgatttcgatcttagattattatgctcaaatatttatctccagagtataataaaatttgaagtttggactcttttgatcattattatttctctgactgaatgaaaaagattgaggttatttattgatattgatgattgttctacaaaagatggattggagttatttataatttagtttgataatgaatcgattaattaagagttgttaatatttaaatgaaaaaaattgatatacttacttagaatagagacattgattttgattataagaaaaatatagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaataaataaataaatgataatgaatgaagttcttatgcaagaatagagacattgacctttttctattcacaagagatagatttgattttaatttgagtcatgagatattgaatattaatttttacagaaaataagatcataatttcaaaatcttgaaatattaaaaatctttgagatgttgatcttgataaataagaaaatggatggttccgttcagatcaatatttaatgtattgacttttccttatgaaatgatttaagaatgaattttatatcaagaattagaatattaaaatatttgtggatgagattcaagtaagaaactatgaagactcaagcaagaaaaatttcgaggacgaaatttcttttagaagggaagaatgcgatagcccagccagcccaaacgaaaaaaaaaaagaagaagagagaaacaggggatcgagaagaagactcccggtaggagtcttcttctccgatcaaacctcggagaacggagtcctaagaccaccaggagtcctaggactctctataaagagacctctcccttcctaagagatccctcaccgatctttttctctcttttcctcccaaattcctccgattgaagccgcagcccttgatcgtgttcaccgcgatttctcgccggcgggaccatcggaggtcgaggtaagctttcctccccttcctctctcctcccccttcctttccgtatcgatgtgcatgctcgccgacgaccggagtcgccagattttgttgcgaaagaatcttcttttttatcgtttttccatcgccggtggtcaccgccgaccatcgatttggcctcctcttgccgccggatcgtctcccctcctaccgacggccacctcacgccggctgcgccgctggccggccaaccaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctatgaatcattgttgaatttatttagatattaaaaaaaatatatatttaggtcgttatgatttggatttaaattattatctaattattccgctgttgttttagaatagcatgataagatgccttgcatgcttatgggatgagttttctatgagtatacggcggttgccatgaccctcgattcataatctcgggtcggaggcgtgacattaagatttttttttttttatggctcgctcttcgaaacaggctacacaccggagaaatccttgagaaaaaatgatggcattgttacatcacagcggcgtgccatgggtcagtaaatacccctccataacttacccatttaaaaaagcagggtggccatttggtttcgcattccctcaaaaaatagtttagagtttctaatcaataaattttcagcaccttatttctcaccaatcttggcttgtctaatacatgtgagtatagatagattccttccccttgatgttgcctttggaaaagttattcttaaagtaaacttgcagcaaattccttttacccaagttcccagacaggatttagttgaaatcctcaggaatgtgcaatgagtggagctcaaggctgcattttcccagtttgcttgtttagatggattggaatgacgtcttcaaggccatgaaccgtagttcgtccgctactttctattagttgatcccatgttcctttatcttctggcaactcactctagttatgagcagctgcagccagccttgtaccatggtaggatatattatgtccctcatcttgccatgatagagaattagccatctctgttctcttctataaaaggtatttaaagtaatcttctttcctcaagattaagtccctgttatgattttcttcttctaaatgtttggatatatgttttctcatatttgatgagaaaatgcttggataacaacttccaaatattttgttatcgtttggcgtaacagcaccaggcaatcactatgggcaattttatattttttaaataatttttttaaatctacaaaaaaaatcaaaaaattgaaaaagctttgtctggatcgagatatatgatgaatactgtcttaagaatatgattcccccctatatataaatctatagcaatcacgtttcgatggttccgaagatacatgatgtttcgaaaacactttatcccttcaaaaaccaacattcattatggattatttcaaaaggaggcatctagcaaaaatttatgcattatgtgaggcgcccatgccttgccatgtgttgcacgtgtgcatagcatgtgtggctgtttgcacccaaccaagtggtcttcaaaggatagcatttctataaaagcaagagaactttcttttatatatacaactagtcgaagacccaagcattgcgtgggatcagatgtacgaaaataattgttcttctagatctaatcagattgaaaaaaaaattatatataaataataaaatgatattcattcaaatttttagaatcacttcatattctcaaccacctatataaatagattttaattataagaatataataataccatacattaataatataatttaatatgaagatgtgttacattaataacataatttagtatgaagaggtgttcttttcaagtggcaaaacaaaactcatttgagaagcagggttggcaacactccaatactccttcaaagaaaatattttaaagcattcgaaccaactaaaatttagaaaataatattggtttaatttttaaaatttgaatcttttcaaaattaaaaactctgaaaatctattaaaaaagatttaaattttgaaaaatataaagaagaaagattgggaaacttaaagagtgcaatgggtgaagtttcctatggatttgatccttacttagtattgagaatattcattcgaaggaaccataatagattagattttgaactaaattctttaacttagacttctacttatctcacacacaataaggattaattgtgtttttatgtagttagtaccaattgaaggccttacgcttagtaccttgacttttcatgagaatttattaggattagttggaaccactagttgcgacctatatgacaattcatacataggcaagtcctctaagaatatttataatctaataccctatacattttttgtcttgaactcattaagagtgtcccttaacctttctaatttattttgtcactgatgttagcactcatcataggattaagaaagatatcctaaaaatgtgctctagcacaatctcttaatcaacctcatttctatcatattgaatctcttttatgagatcttcaatcataaaggttaaatatttacggtcaatgaccaagtagtagttttaagccccattctccttgatgattctagggctccactcctaaataaactcttagttaattgatctgccaagtttttttaagatttgacaaattctaaggaaataacattatgccttttgagttatcttgcaaaattatactgcatctgaatatgctagctcatctttttattaatattcttttgatcagtcaatatgtaatgaacttattatcacaataaattgatatggtcagaactagcttaggtactcatagcagttttcattaagattttaattcactctgtctcaataaaagcgatatacaaaaaaatcaacttgacctctatgattctctagaatgtagtagtttgtctagaagatcctaaagcaatagtaatacagccaagaagaaaagatatctgataattgattttaaatcaaaagaatcaacaatctaatttgcatcattgtaaccctcaaccatatcaaggtatctagtgtataagagagaaacaagtggatcccttaagatactaaaaacccttttaacagttacctaatgagattgatttgggttttagatatatctacttagtctccctacaatataaacaatttcaggtcctgtcctatttgccatatagatcctatatatcatttgggagcatctaatttgataaactagttcaccaatgttctttttaagataagtccttggatcatatggagtagatataagtttataataagaataactaaatcttttaatcatttacataagtcctttttatcaaaatgatttgaaagaaattatttgatttcagatataaatgtaagaaaagtttttaagatcaaaatactatcgacatataaataaaggatcacacaatcatcatcaatgactgtggaatatacacactagctatgatccttaatggtgaaactaaaagacatgatggttttattaaactttgcatgccactatttaggtgctattttatactatattaggacttaacgacattgcaaagtttgttctcttatcccttcacaatgaatccttcagactgtttgatgtagatctcttcatctagatctctatttagaaatgttgttttctaatctatttgataaaggattaacttatggatggaagaaatggcaagaagggttctaaggatggtgattctagctacaagagaataaatatgaaaataatctaaattcttttttggttatatcccttggctactaatctaaccttatacttttctattaatccatcaaatctaagctttttacaaaatacccacttacaacctaatggtctactacctaaaggaagattagttaggatctagatttggttttggattattgagttaaaattagaatttatagcttctttctagaaagggacatcaagtaaaggcattacctttttttaagtggaagcttcaccttcaactaggcaggtaaagaatcctttactaagatcctttttcttccttatcctcatgctttttctagattcagaagattagtgattagggttagacctattcctctttcctgaaatataaggaacctttgattcaataaggctaagattaggagatatattagaatgaatttgatttgggacttggttaaacttgcaaaatatcagcatatttcgtctctataagagtattgttaaagatatcacttatcttagaatgttttattagaaatttattgatgctactatcaaaaaaatattttacaaagtttgtatctatagttttaaggtcaatttttttcttacaaagtttgtatctaggagttctatcctttcagagtccaaactatatcctattattatttatagaaattattctattttggatctaacatgttgctaaaagagtttccatctgagctaaaaaggtcaccaaataagatatggatcattttagatactacattattcaagaggatcgatagacttgatgttgaccattttgacgactataaatattcaggatgatcatcagactcgctgaagattacattaatcactatgagtattcaagaaaatcatcaaactccatgaagattattttagtcaccacgaataggactggataggatccgaaagcaagatcctctacatagagaaatcgaatcacatgtcaaattttaaaagattataacttggtcatacgatattcaatttatatatattttttaaaattttttgaaatcggatagcttttcaagatctacaactttggggtaacccctcctagagagttaaattggatcgaaattccatcatttgggtcccgaggttagtcaaatcgaaactttttttctgaaaaatattttgattgagtgttatctttcaatctgtaaagaattagataaagcaacaaaaagcaaagttgatgtagaaatagagatcaatatattatagaattttagattttttcttaattatttttattattcaaattaatttttggagatctagtcctttataaattagaagagaaattctactctagttaacaaaaaatctcactagtattataaatagaggttatatatctcatattatgagtgtggagatcaatgtaaggaaagagaacttacggtctaatttcaaaattcttttatcttcttctagttttttttttttttttgaaagattcaagtggagtaagttgaaaagaatcttctttctccctgattagaatatgatcttttcattccattatactgttggactacaaggagtaacaaggagttagctgatgaatgatctcatgttcttagcaaaatagaatcgtttcatttgaggtatatgctccatctcgatcaaacctaagttgttaatgatcttttcaatttaggtttcaatttcactcgtaaagattttaaacatatctaagacttaatacttagatttgatcaaatatatataacaatactgaaagaaatcatcaacgaatattatacaataatgatttcctccccaagttggcaattagtagagtcatacacatcactatgatcaaaacaaagaaggttagaaattctatgagctgatctggaaggtttttggatatttctagttggaatatagatttcacattggatctttttattcaaatagattttaggaatcagatttgagttagttatatgatgtatctgatgaaagttcccataagcaaacctactatgccaaacattagaagattcaaaacttagaatagaaaaaatgatctttggtagaatttttaggaactatacttgatttgaataggcctttaaatataaagtcttttccaacaaactcattattacaagtaattgcaaacttattagattctaatataattttatagtctctaaatacaagaagagatccgttgattaggctcctcttaatgttggggatgtactacacttggtgaaggattaagattttttagatgttatctttaggtccattcgacctcttcctaacacttattctatgaaattattttcaagcattatacctccttcacttgactcctaaaaggtcaagaactaggagtaatcaaaacaaatatgcacattagctccaaacttaagccaccaatcacaagaagaatagataaggaatatcaaagggttacaattttgtgcttgaagggaagtccagcaccattttcaaccatattcactaaaggtttagctgctcctttcttccaaaatttggccgttatatggtagcaatctctttgtatgattggtccatccatatatgaagtagaaggtcttcttttttggctctaattgagatagtttggcttctaaaagattcggagaaaaagaattagtttgatcaattttgggtttttttttcttttttttgtaaggattttccccaaggtttgaaaagattttattggattcagtcaattaatcttggctccaaaatcagatttggtcttaagcttaagccaatgctcttctttattctaataaagtttatgatcttcgataggattaagtcatcttacatatgactcaacttctgagaaaagctcgaccaggatgaaggaagacaattaataaggatttgaaattcataatttttagagaattggcaaccggtcaattcagtctcagaagatcttaaaattcatggatggatactattggatttggattccaccatacttcactttaagggcatctcataatcccttagctgatttggtgggaaagtacacaccatacaagaaatcagaaaagacattaattatcctatgacggcagtagaaatcaatttcttcataagttttaatatggcagccaaaagatctagaattttaaggactaagagaagatgaaggttgagagattaatccaaagaatagtatatgatcagggaactttatggtagagatcaaccctcatgtaataagccaatattttatttagctttgccacctttcaaagaagaatcctctaaacttcttagattttattgcattatgatcatgaaaagaatgcatttataaatttttgttggtcaattggttccgcaaacacaagtttcaaaagatttagccttatgtatttaaatggttcattaatggcttccaataatacaaaaccaggccttgaaataaatgcaaaaaagagaaattacaacaaaattaaaaaattacactaagatatatgatatataaaataatttatgatttctgcatggtttttaaagcaaaagatatttcagcataatttttgaagatgcaaaaatttcttcatagaattttgaagttgcaaaatatttatgcacagattttgaagctgcaaaacatttctatatagatttttaaatctgcagtaaaatatgttttgcactattttttgagcaatgaaaatttcttaagcgattgatttttttggaaagaaatcaacctctaaacaatagagataaatctttaatcttattctacacaatcaaggcaaattaattctatataataaatttaattttgataatagcaacatctaggataatcaagatcatgttagactgctggcgtaatggcacctagaaattgctatgttataattttatattttgcaaataatgttataaaaaaattaacaataaaaaattagaagattaaaaaagtatggtttggattgagccatataatgaacaggactcaaagaacatgatttgcctcctacattcaccagactgattttctcaatgcccgtgacttgagcctcaaagaataggatttctattacgcatattgttcctcttttttttattttccctattgaaccattcatttacgcttcttccaccaaccttatttgttgggaaataccgaccgatcccgctcatcccgacttataaccgggcgtacccgaccgaccgaccgaccgatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcgccacctaccaatgacttgtcaataaggtctttaaagatcagatcgggcgcaacatggaagtatacgtggacgacatgctggtgaaaagtgcgcagattccggatcatgcccaggatctcgaagaaacctttcgcactctacgatgacaccgaatgaagctgaatccgactaagtgcgcttttggggtaacctcggagaagtttctcggattctttatttcccagcgaggaatcgaggctaaccctgagaaaataaaggcactcatcaacatgcgccagccgaacaccaagaaggaggtccagcagctgaacgaaaaaatcgtcgctctcagccggttcatctctcgatcggctgaaaggtgcctcccattcttcaaaactctgaggtaggcgaagggcttctcttggtcggacgagtgccgacgggccttcgagaatctgaagaggtacttggcttccccgccgctgcttgtgaagccggaggtcggggagacattgtatctctatttggccacctccccagaggcggtcagttcagtgctcgtccgagaaaatgagaaccgaacccatcagcctatctactataccagcaaagtgctccgcggtgctgaagctcgatactcagagatgaaaaagatgatttttgccctgaccgtctccgcacagcgactccgcccatactttcaggcgcatgccattgtggtcctcaccaaccagcccctgagggcgatattgcgccgacctgatacatcgagacgactgacgaagtggacgatgaagctcagcgagttcgacatacagtaccggccacgacctgccctcaaagctcaggttctggccgacttcatcgctgaatgtccgacggtcgaccaggggtcggaagacgcagaccccggacgagatgcggtcactgagcctgacccggcctccacctgggtactgcacatcgacgaagcttcaaacgttcaagggagcggggctgggttcctgctcaccaactcggatggggtagtcaccgagtacaccctccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctcaacgaagacatggccatttcgaccatgaaacgggggctgagggcatcccgatttacttactccctggataaaatcctcctccgaacgtacgtcgagctgcaggaaggcgcgtacaagtatatgcgcgcggacgaaggagcttccgatcgacgcttggccgaacccaaaggcccgaaggagaagcggagaaacggtcgggaccccactgcgcctagcaggcccccgaccgatagtcgggtctcacccccacgacgggaccagaggtcgccccatcgatggagcccaaggccgacacgccccaggtatgattcttacactcccctctctgcccctcgtgcgcagattttgatggaaatcgaaggggaagagtacctgcgacggcctccgcctctgaaggcaaagggcctcgaccgacgaaagtattgccggttccaccggggccacggccataataccgagcaatgcatccagcttaaggatgagatcgaagctctcatccgccaagggtatctcgataaattccggaggaacccgtcgactcgaccagtggccgaccgacgaccccagccaactgaggaggcgaccactaatcagccgacggtcggggtcatcaatatgatttccaagcgacttggcccggggacgtctgctagaggggagcccacgaagaggctacgcccggacgacgtgattacttttacgaaagaagacgttcggggcatccaaactccacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcctgcgacagggttactactggcccaccgtgaggaaggacgcggctgagttggtccggaagtgcgaaccatgccagaaatatgccaacgtacaatatcgatcggccagccaaatcactcctattgttgctccatggcccttcgctcagtgggggtcgacattctcgatcctttccctccagcatcggaccaaagaaagttcatagtcatcgtcatcgactacttcaccaagtgggtggaggccgagcccctggcgtagattaccgaacggaagatggaggacttcgtccaaaaatccatcatcttcaggttcggattgccgcataccattatcaccgacaatgggcgatagttcgataaccaagacttcagagacttctgcacgaggtttcgcatcacgcaccgactgacttcagtcgggcacccgcagtccaatggcgaagtcgaggtgaccaaccggactatactacacgggctcaaaacctgactaaatgaagccaaaggcctctgggtcgacgagctggactccattctgtgggcttaccgaacgaccctccgtgtttcgatcgaggagtcgcctttcagtttggcctatgggacggaggcaatgataccactcgagatcgagctaccatccaccagggtcgagcggtatcaagagccggacaactctgattgccggagggccaacctagacctcctcctcgaactgcaaaatgaggctcaacttcgtatggcttcataccgacagaggatagcccgatattacaacgccaaggtcaagccgaagcttttcaggcctggggacttagtcctgagaaaggcagaagtctcgaagcccctagaccaagggaagctggctccaaactgggaagggccctacatggtggcggacacctacgggccaagggcttaccgactggaaactttggaagggaaacccattctccggacctggaatgccgacaatttgaagttgtatcaccaatgagctttgtacctgttcatttggaatgcaaaaccagtcccaaggttcggagttttcgctcttcgactgacgatcggtgctcgccaaaaaggccgagtcccgacgtcccgactcagacttaatgtccacgtggaaccgacggcccgatcgccgacgatacatcggacgctcacaagggccaaatcgtccacaacaacgggagttagcgctccttctacggtcgaacttttgggctaaacgatcggctaacctgccgactgagccccgaccaaagaaaggcgtgacgcctacgcgaccgacgtcgcgacttaccgactgagctacggccggtcgaaggatatttgacttaccatcgtctatcacacgatgcgaccacagtcgcattcatgactcaccgaccgagccacgaccggccgggggatattcggcttaccaccgaataatacacggtgcagtacccgacacaagggtatcggggtctgactcatcatcgtttccccgactaaacatgccggacgatatttgactgaatgcgttgaaagagacccgactgtcaagtcttatccgacggtcgatcggcttccgactcacagtcgggcgaaggacgcccgatttaggccctcgaccatcgaaaggccgatccaaagtcgggacttgttctacctttgtggcggcacgaattgccgaatgtcctaactgatctatatgggttagcgacttacgtgttcgaaagcatgccacaacacatgaaaagagagagacaagcgaagaaaaaagtttaagtccaagactttgattccattgaagatcaaaatgggctttacaaagttgggccgaagcccgaatacaagccggagcaaaagtaaaaagaaataaaaaatcgactaatcatcggagttggcctcctccactgggtagcgacgggggacggtcggcgaatccgctctggcttcggcagtcggggccgcctgatctttggtagcctgctctgcgtcttcttcggcttccgccctagtggaaaggccttccgatactggttcggccgtctcctccacagctggggcctccgactctgacaaaactatgctgctgagatcgagctctgggtacaggccccgaacagcttctcgaacattctcgtacccgacccgatacgaaaggaagccgctctccagaagctcttctcgatactttttcgagtcacgaaagtcttcgacggcccgacccaaggcctccttcgccgattctgcttcggccttcgtgatgtctgcgtcggcctgagcgatagacaagccttcttcggccttggcaagatttccgaggcttgctcgaagctgctcgcggtcggcctccagctccttgacgaggccgtcccgctcgtgccgaagccgacggacggtccgggacttcttcttcgcatcatcccgggtcgactgaagctcggactccgatgtcgccaaggcgcccttgagtcgggagacctcctccgtaagtcgggagacctccccctcaagtcggccctcccgctcgaccgactgttgcagttggtcgaccaggacgaccctgtcggcttcagcgaccgcgactgtctctccaagccgcgcgcatgtcgccgaactttcggtatccggcctctagctcggatatgttgtagaccagctgcagaaacaaaaccgactgtcaagaggccgagcctacggaaaccacgtgaaaaacgaaggaaagagggacttacccggatcatcatcggataaaatgaagacagcatgtcggagacacgctggttcttcatcgcatcgatgtcggcaggaaggaggagcgcctggcacagtctcctggccaagtcatggttggccaagcccgacgcaccttcagggagtgggaagtcggtcgatcctccgccggccgaccgtccttcatcgcccgacgtcatggggaccttccctcggtcggacgcccaggccctgcgtcggaaatcgacggcaggcttgagcccgatcgagtctcgatcgacggtgcggcagcagcggccgctggtcgctcggggtcgtgagcctcccccgatcctcctctgcctgctgggcggccggcgcgccatctaccgactcagccgccctcctttcgggcaaagcggcgcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatcaggcgacgaggggattggccgcaatattattaaaataaatataagaacacgagccccaatcgcacttaacagatcatgcaaagccaatgcttgacatcaaacaccgtggcaaccgacatatacagcaatctcttaaagccaacactattacatgatctggtatcaatgcgctgccggctataatcgattgctgagtataacagcatgcaatgtttaagaggggggacgtcaaaatagagaaccagcaatgataaaggttttgtgcatcttacctctcaaaaggcagcagccatagtaggacccgccaagcatcctcttccacgacctcccaaccaagccacgacaagcactccacctgcagcaaaatcaatcgagggcttagagattaggagagggcagaatggaggaaggtttgatggctttaatgcgtcgaactgactctagctagatcaagaagagaaagcatggcggagtcaaagatcaagagcaaagggagtaaagaggactcggcagaggagattgatatggatcaaggtggagagcagctggtaggcgaggaaggcagagacgactacgagagaagccaaagaggagcaaggagaatttaatttttctcgtaacgatctctccttcgccatttctcaatgcaacttatcatagtgaaaagtcaattttcttttttttattcagaattttaccagtcaaaaatctttgctttcttttcctttaaaagcataaacatgtgaaaatagtttagaattcctaaccaattaattttcagcaccttatttcttactaatcttcgcttctttaatacatgtgagtatagatggattccttccccctgatgttgcctttggaaaagatattcttagaataaacttgcagcaaattcccaaacaggatttagttgaaatcctcacgttaggaatgtgcaatgagtagcgctcaaggctgcactttcccagttagctcgtttagatggattggaatgacgttttcaagcccatgaaccgttagttcgtcacctgctttctataagctgatcttatcttcctttatcttcaggcaactctttctggttctgagcagctgcagctagcccacgtacgacagtagcatatgtgattcccctcccgtcaagatagagaattagccatctctgctctcttctgtagaaggtatctaaagtaaatcttctttccttgagattaagtccttattatgatttttttcttctaaatgttttgaaatatgtttcctcatatttgataagaaaaggcttggataacaactttgaaacattttgttattgtttgtgcaatggcacttagaaatctccgtgttgcaattttatattttttaaatgatactatgaaagaaaatctgcaaaaggaaaatcagaagattgaacaagctttatttggattgagatgcataatgaacactatctaagaacgtgattcaccccatacaagtggatctgcagcaatcttgtcaccaagatgctcaacccaatccccctccaacaagtacaatcattgggatgctagacccgatcggcaagaaatagttcgtagaaaagagagaggaagtctctatcttaaaatggaagaacagtctctcgagcttagcaatagagagagagagcacaagagaggggatggatgtattttttttatctatgtggctgtcccaatgcattggaaccaaaggatcagatcctatttatagaaaattaattttttcatgggtttaatatggatgctacagaatccaggatcttaaggactaaaagaagatgaaggttgagaagttaatccagataatagtctaggatcaaagaactctatggcagaaatcaacctcaatatagcgagccaatattttatttggctttgccatcggctaaagtaggatctactaaatttctcaaatttgattcactatgatcatcaaaagaaggcatttatgaagtttggttggttaaattgattatgtaaatatgagtttcaaatggtttagcctaatgtatttaaatggttaactaatggcttccaataatataaagctaggttttcaaataaatgcaatagagagcaattacaataaaaatttaataattacatcaaaaaatgtgacaagtaaagtaacttatgatttctgcatggttttcaaaaaagcaaagatttcagcacaatttttaaagatccagaaaatttctatacagaactttgaagttgaggaatatttatgcacagattttgaagctgcaaaaaagtttctgtatagatttttaaatctgcagtaaaatatgttttgcactatttttttagcaataaaaatttcttgaaagattgattttttgaaaagaaatcaacctttaaacaatagagataaaactttaatctaattctatgcaatcaaggcaaattaattctatataataaatttaattttgataataaactaacagcaatatctaggataatcaagatcacattcttagacttgttggcataatggcatctagaaattgctatgttacaattttatatttttcaaataatgttataaaaaatcaacaataaaaagttcgaagattaaaaatgtaatgtttggattgagccatataatgaacagggtttcttttttttggtaagatataatgaacagggctcaaagaacatgatttgcctcctacattcaccagactaattttctcaatgcccgtgacttgagcctcaaagaataggatttctattataccaaaaaggaaaaaacttgcatttctataaaaacaattgcatatctaatgtgggactaaaaaaacagtattttaaaggatttgaatcatcaaaaatgtggggatgatgttggttttattttctaaaatttaaatcttttcgaattaaaaactccaacatttatgtcgttatctttgtttacatatctcatacacaaattaaactgtttttgttttaggcaggggcatggagtttgtgtcttcgtttttgtcctcaataacaactgagatcgcgaaatgtgcatggccgcatctcaagactcaggtggcctactgtgcatgttccaaaaagaaagtggaggaactcaggaatcgtatgcaaaaattgcaaccgctaaagaatgacgtggcaagacgagtggatgaagcacgtttaaaagatgaagtgatcgatgatgtagtgagtgcatggttagaaaatgtaattgacatggagaacaacacgcgtcgaatggaagccgaatttgaacagaacaagagatgctgtaaaggctgctgccctgatcggtcttggcgctataggctgggcaaggaggctgcaaagaaagcagttgaagctgagaggctcctgcaagaaggaaattttagcggtgtgtctcggcctccaccaccaccaagttttgaatctataccagcgggagatttcatcggcttcacctcgacgagagaagccatgaaaaaggtgtttgatgcactggaagatgaaaagacgcacttgattgggatttatggtatgggtggtgtcggcaagacaaccttaacggaggaaataggcaggagagctagaagagagagcatgtttgatgctgttgtaaaggtggtcgtatcacaaagaccagacatgcacagtgaaaattcaacacgctctagcggtgagattgggcataacacttccggaggatgttaacctagcagctgcagcacttgcttccaggataaagaaggagaagaagattctaatattgcttgatgatgtctgggataggttagagttgaaaaaagatgtcgggatcccatttggagaagaccacaaaggttgcaaaattttaatcaccacccggaaagctcaagtttgcggaacgatggagtgcgacactgcagtccctgttgatgtcttgtcggatgaggattcatgggttctattcaaaagcaaagccggggaagtcatcgaggatcctgatttggaaccattgacaagagaggtcgttaaggaatgtgcaggcttgccacttgcaattgttgtggttggaagggcactgcgagggcgcggcaagaaaagcgtgtgggaaggtgccttgctgcaactgaagcgagctattgctaagaaccttgaagatgtagaggaccaattgttcaagtgcctggaactgagtcataattatatgaaagacgaggagactaaattattgtttttgttctgttgcttatttcgtgaagactacgaaataagcgaggacgagatcgcaaggtatactgtcggtgagggattcttgaaggatgtcgacgaattggaggttgcccgagcaagagtgcatctaatggtggaggatcttatagcttcttgcttgttattaaaaaccgacgaagaccgggttgtaaagatgcatgatgttgttcgagatgtcgctgtagatattgcatcgaaacgtgaggaccgtttcttcgtgaaagctgggctaggaaccagagattggccagaggaaaatttggaagaatgtcagagattatcactgatgaataatgacataagcaaacttccagatcagccaaactgccccaaggtacgtacactgttactgaatgccaatcgatcaatacgtagcttgccgaatgacttctttaaggggatggtatcacttactgttttagatttgagatacaccaatattgagtcattaccttcatcactttcatgcttgacgaagttggggacacttctcttggatggacgcacaaaattacgtgacatctcaccgatcggacacttgcataaacttaagatacttagcttgcggtggtgtcattttgatgtatggccggaagagataagtgctttggtcaatttgaggctcttggatctgtcatactgcacctctcctgaaatacggcccaatatcatacgcaagctatgtcggttggaagaactgtaattgatacgttgcacaataaacgaagctttgctagttgaaattgcttctttagatagcctggtctgtttacaagtttatgtgaagggtgaatgtttttcccaggaggtgattcctcctggtggtttcaaaaacttagacaaattcgcctttcaaactggagaccatatattcactgatagatatcagaggaaattttatctcagcggagaccgtaactttgcaaattggaccaaggaattgctgaggaaagcagaggaccttgcacttgaggaatgcaggtgggaattcgcgagtttggcaccactagacaaaagcaatggtttcataagtctgaaggaactcacgcttgaatactgtcatcacttggaatgtctccttgacacacaaaagggggcttcgctagttgcctttgttaacttggaagatttatacctttggtacttggataacatgaatatgatctgcaaagggccgcttccagctctttcatttggaaaattgaaaacgctaaatatagacagttgcaacaaattggtcgatataatgccatgtgactttctgcgaagagtgcatggctgtttacaagatgttactgtgcgaaaatgtgagaatccacgtgtattgttcaacttcgaaggactccagagcgaaagtgtagtgctgccaaatctgaagaaactatatctttctcaattgcaaaatctaagcagcatatggagtggagcagtaccgcctggcagtctgaagaacctggtttcgataaaagtctatgaatgtgatgaacttgcatctattttctcgcgacagttggatttaagtccctcaaaattcctacctccacaaacctttagaaacttgagggagataagcatagagagctgcagcagctttaggtatctcttctcagcaagcatagccaatgaactccaaagtttagaaagattggtgctggaagataatgataacgtggagacagtaattgcaaaggaggatggtgttatactaaaaaatgatgtgtttccctttctcaaggatctatggctcataaacttgctgatgctgaaaagctttcaccaagaggagccagcagatttatctattgattttccttcactaaaatacatcaggttggggagctgtccacatctgagaaggcttccatttggcctagaaagtgcaccaaggctgaggacagttcatgttgcaagagatgaagatgtgaaatggttccagagcttggaatggaaagatgcgcgcatcccttcacgctttgatttcgagtaagaaatttacctagcaattattctgcatgattcacttatgcttcgtttgttctccaatatcatctctgagcacaataacaacctaaatgttttgtacacaccagggttgctcccacctgttgtaggactcccattgagataggtataacagaccactgaacggcggcatgcgaatcttttgattgctggcgattcattatgatttagaattcaataatacccactgaaatagataggcaagcgatgatgcgtctaatttgaatcgaatttggtaattgaatctgggacaccaatacttcttcatttgcaagtgcacccattgttattcagtttttacagatttaccttagaaaaagaatttaaaaatggtcacatgtttgaaactcaaatcaagatttaagactcaaataatcgatgcttttaactcagattccaggtgattacaaacttacatcctgtttctgcctgtaagcttttcaattttcaccaagcatcatgatataatttactctattccgtacttgtgaaggctaaacctgtgatagtctacagtcaggctttagcaacatagctttttcaaattatgtatttatgtggagtaatcattaattcaggactttcaaaccaccgattgaaagccaacttattttggagtaacttttttgatagaacaaacagttgaaagataagatttttgttgtctactctgtttttgtaaatgcttcttaataatggctgggaggatcttccttctttttcccttcatctttcaatgctgctaacaaaattactatgtcaacaattaaaacaggaaaaaagagtacctatgatgaccaaaacgagccagagtatcggaggaatggacgatatatggacattattgtggggagaagttgcatgatgccctctgtcaaacactatctcgcttggatctacttgtcttcattttacttcttgcttaattactcgtatgtagacatgaggataatataggttgctagagacaatttactccgtgatttattgatcactattcaataatgactgacggcattactctgataaataaaactagtaagttgtagaactgctttcacagattacattataacaagcaaaatcacttgtgcgggacgtgaacaatactctcgcatcttttttatttgctttccgtaacttttagcatgttacctcaaatactgtaaacccgtttttatacaatatatgcaaccttgttaaggcttcttttctgtgtgaaatattgaattaaatccatctttctcgctaaaaaatgggaaattggagaacggtaaaatttgccattatatcttcttgtggatacaagcaaaggctacggtcatgcgctttgagcaaggaatcttgaaagcccgaccttgtgacctgtacgtctaacatcctcttggacttgctgtttgtactccccaaagctaaactttgtatagatcgcaggctctgcatagctccgtatcacagtgtcataggagggacacaggaagtatgccactgagaacctctccagttgtgggttggacataactctgtgttccacactcttgtacaccccattgctccatgcctgcatggactcagaaatcacagcgcatgccaaaccatagtaattaaactaagattttaactactccttcggtggataagacaagctatgctgttataggaatgtcaaaatcattaccatacgaatatcatattcaaccatagttgcttgtgttaacgttactctgaggagtcctgtcatctttcaacaatcatgagttattattatctttttcttttccattttagaaaaatctccatagcttttctttgaaggagatccctacaagattttgcccgggcaagcagaagtcgttgctaatgatattgaagatatatatgtacatacctggaacaagtcaccaatgttgacaattaatgcatcaagatttggtttgacggtgatccacctgccatccttcatcagttgcagcccacccacttgatcttggcgtacaatggtcaggaaactactatcagtgtgagggatcaacccaaagactccagtttttacgggacatggcggataacgattcagccgtaaataacaagtattacgtgtgcagttctcctttatatacgtgccgtcgtagccccccaaaccttcagctaatatccccactagttgatgtgccaaccgtaacatcgccgtcgagaattcctctattatgtgcctgtatcaaacgataagaatggttacggatttcttttaatcagagagacggacggttgcgaagagccaattctagtttctttttttgcttgttatatacatgtgtaagagcagcacagaaattctcgtatcgtattaattgtactcgttttgcagtggaaccacaatgatcgttaagatgtgttccaaagactgtagtgaactattacattatatgtattttgaatttttagatcaaaaaattttattttgaaataacagcgtagaagccattgagatggcatcccagcgaaataggtctttgttttcaatgacctaatccaaactccgattaaatgtcagggcatgaatgacgctcaaatcgagcgtatcctagtgatttagatatggcgagtaaaaccatacagggctatgtgtataactaagcaatgatcatgataatgatatcatcattattgcatctggtctcataaaaaacctgggtattgtccatggtgtgcatagcatcaaaaaataaaggaagtctatttccatggacgatgccgtgtcatcatttagacccggcccatataaaaataaattaagctgcatgggctatctcacggccatgattagcacaaaaaagaaaaatgcataaaaactcttacatctaacaagatttttatatgatattatatgtgtgtgtacatatataatattaatatgtatgtacacatgcgcacgtgtatatatatatatatatatatatatatatatatatatatatatatatatatatatatatatatatatatatatatatatatatatatatatatatatannnnnnnnnnnnnnnnnnnntatatagtatatatatatatatatatatatatatatatatatatatatatatatatatatatatatatatatatatatatatatagatgtgtgtctgtatatgtatatacacacacatatacatataatatatatatatatatacacacacacatacatgtgtacatacgtacatctatgcgtgcggacgtgtgtgtagaaaaagaaactacatccatttcattacggaaatggagtacaagattttcttttttcaatagaaatgagaagggagaagggttcctacaagggagtacaagacttaagcaacatgcttagggcaaacaaatcaaagcacaatagaagattaaaaaaaagtaggagagagatcaaaattgcaagcttggaaaacaaataagagttttttctttttttggataaaaccggtggatttccacccttcttttaatgagttgtttggaatgtacacatttgcatacttatttaccatgtagtgcttggcaaggacttagaactaattaggtagtggcatgacctattatcatatatgccgactcttgtattgatatttgatagcctcctcaacaaacgagagtttttagagaaaacaatatgattccaggaggatcaaagaagcacggactctttcatggcactaagaatgtaggtggcaaccaacagaatggataatatcctgttcatgttgaacagaataagtacctggggctagctttggtgacatcggtggacggtgggagagggacatgatatgcttcggaccatgataattgcttgagggaagtgggcctcggcgtcccccagcgataattctcaggcgagaagtccaacaacttctcactggccttcttctggaatggctgtcggaacacgtcaaactgcacctcgcgtagcctatccaggatactattggagatgccatggttcaccacctggaagaagccccactcggaggcagcaactttgacgtctctcttgcactgctcctcgtggtgcttaccatttagacagttgagatcgatgatagggagctcgcactcctcggctattaccgtttgatcaatatcagatgaatgtggttggctatccaaaagagccttgtaggtggtgaagaacggtggattgggatccattagcactgcactatgatatttagcaaacaaaaggaataggatgaggttaacacttggtagctactaaaaacaactaacacttagtataatttaaagagcatgaatcctctatgatgcaccagctgcactgcaaactggtacaccacccatgatggttacctaataagtggtagacgaccctcaaataaagaaatccatggacacataccatgttatatatagcatgtattgttaatttgatggccgtccatctcttggtgatggccatcaaaagcaacatagcaccctatattgcagcccacataccataggttcttgtttggtgatttaaataatttgtgtgtgtgtgtatatatatatatcacataagaaagaaaaaaaaattgcatttgggatcccctcacccacctgaagatgagcggtaagcttaccttgtgggctcatttcctgattcttagttgctacatacaattagcccagtaattcaaagctttaggtttgacatccatctcaacctaactaaagcctgactcaaattagttctaacatacctttaattactattcccaataatatagcacctagaagcttcatgggttgctacgatgtaagttgaaattgaatttgttaatatagaggataaatatggtccattttaaattatatttttaaacccaattgctacatatattagagactatcaaaatatattatttttaatctcttagaattttgacgagcagaaattattagtttcagacttgagatgagtagaaatccacttctcttatgaggagcatagtccatcccaaaaacttggtatatatatgctaaacttcattttgtgaccaagataaactttttttaagtatcaaaccaatctttttgaccaacattatgatactataaaaaacctgagttcaaaaaatatgactactttatttggataaaaatgcaaaattgctagccatgccaagatcctgttgtgctaaaataacttagttcaattgcccagagcaaaccaaactgatctttgtgatctatattgtgatattccaaaaaaaaaccttagtcccgagaatacactaatttatctggatacaaaacaaaagtgctagccattccaagaacctgctatgctaaaacaatttatgttatcatgtaatcaaagcaaacgttttctcttgagtaaggacaaaaccaaaccaaaccaatctttttgacccacattataatataccaaaagaaaaaaacttagtttcaaaaacatcactactttatgtagataaaaaaatgttacccatataaccattaaaagtgaccattcaacaatttattcttttttttttaacttttggtaaaacttcaacaacaatttattctttaatgagcaaacatgtcacacagctctcataaattataaacaaataatcctttctccggataacaagaagggattggtgcaactcatgaatttattcctcgagactgcagattgattattatggaattgagaagttagtggctgtgcaccttaaccaatagatcctgtttagcaaagatggatattttttgcttattattagacaatcaattattcacaaacctcgtgtgggactaataattttcatttttcatcacatgaaaaaaaattttatgtgcatttacggcatgccaaagcatttacctaccgatagtatatataatatcctatctaccaaatgtaagtctacagaacgatgatgtgtagatttcccatgtaaaatagttgaagaagaatgtagatgattctgttaagattaggttgtggtaaaattatttcgcgcctcttatatatctcctgggcaatatattctacttactatcatatatcctattaagaatagctgataataaagcgtaataaatttcacctggttggggccgtcactgagccaagctagttagatcggcacgctcttgtacgtacctcgctcgtccagtagcatactaaggcttgaaagaaggtttattttaatttaggctctagcaagtgatcaagatgaagcgtgcggtaacaagatgagcacaaatcacttgaaaattagcagactagtcatatgatttatcatattatatgaaactagaacttcttcacatttttttagctatatttttgctctcatgcatgtaatggttgatcatcaatcaaccatgttcacatggagacatgagagaagaagagtatggcaggggttctggaagaacgcaagtatattacagaaacctagtccgtctaaacttaaagatcgaataagagccccaacacataattaagttaaatctaaaagggagcgtggaattaatgattggaaaacttacttggagaggagacgagggaatgcatatatatgccagggggaggagtgggaataactaagttggagctagaatatatagacaagaaggccgaccacgcattggccatttgttggtttctggttgttgagaagagcacgtttctgaacggagcatcaaacgaaatggagattagatttttgctgaactgattagatattgggaggagaggtaaaggagaaatgatggccaatgaacgaggacagtgggggtgggaggagggatagagttggaggaaggagggccagttgaaggggaggttacagtatccctttcttctctctctccatggccagcaagccacaattgacgctttcatacggctcactgtaccagtgcccaccgccaccgccccccccccttttccttccctgtctctctccccgccctcgcgcccatgtcggtaccgtaggctaactcgcgtgccaccatccgattggaagatctcgccatgttgacaggagatagacgttttgggggacgcgaccatgtcagatcgccacgtgggcctcactcgagcggcggcagatcctgtgcaacccgggctaccaggaatctgtaaagcaggggacacgtggtcttatcttctatcagagaaattattgcatacagcgcgtgcaagcaaaccaggataaatgctggagcacatacacggcggatagcacgccatcgggaattgatgaaatacaagagatggcgtggtgtgttatccaccatgaaatttgatgcggtccaattatatctgatgcatataatacggaggccttctatcaggccacgacgatactaatgacatcagcaataaggatgagggcatgttgaagggacaaaaattttatatgtgcattggggttgggatcgtatttgataggtccaaatgaaattatcaagatgattataaattattaataatttttatcttagatgaatttaattcttaataatttaaaatcactatatttgatatgctatattttagtgattaaaaatttttagataacaaagagtaatctatttgatattccattggagtccaatatcactaagcatataatagcaacactgcatctaatatattacataaaatatatttattgatcatatcaaatatactataataaattattaatatatttattgttaaattattttataaaaatatattcattaatcctagaaattatttatccagtaaaaaataaattagtcattattatagaattaaaattttcatttacacttataatatattattattttaatactaatatctattttgattagaaaaataaggtaaattgaagtaatatattaaatgatttcataatatagatatagagtataataatatatttctattataatttaaaattatattgaataaagatatgataatatatgattaacgatatattataatataatatatatcataaatacaatacatataatattaatataatatatgtaatattgatataatatatcaggtatattaatatacaaatttttttgtcggatcagaagacatttggcatctccaaattttggcccacggtcaccatcctaaaatcatcttggatacctaacctcaaaaatgagattcctatcactggggttggatggttgtttaaaaaatagcaatacgtaatttgaaattattattacgtagaatcattatagtgcaatcaaatatcgtgatctcatcatctccatttatatcatccttaattttgagatgatcatcctataccaaatacctataagagtgattatatgaggcgacctttcttttttaccatctattatatcacatatatcttaaagtagaaaccagatacttaagagtaagacgactcctattaatagagtccattcatctcaagacttaaaacaacaaaaaaagaaatatgtgaagcatcatctataagaccatctatccgtattcctatatttttcttgtcaagttatctttctctttccattcatctatgagacttttctttttcttcagagtctcttttttctcctctgaatttttatcctcatgaaagcatccatcccaaatgcatagcttatgatcatggactgtatactgataaacatcatattttaaaaattatatattaatttatttataaatatgtactaagtcatcattagataagtattaaaaaaatttaatgtatgtatcaaaaacaatcaaatatatatcatctaggtatatcttacatactgatggatacgatgtttttgaaattttatatcaatttatcaggatgtgtctcgatgcgcctgcagctgcggtgtgcgtgattttccctttcgccgcccctttccgctgaccattctacgggcctttgtcctgttccttttaaatcaatccaacccaagcagtcctgcatgtcatgccaaaaatatcatcaataataattgaagtggtactaacaaaatgattggcaccctcatcctccacacctttgcacgagagatttctagatagggacacgtttctatcatacttttcagaaaaaaaatgattgtgagaaatctgtccaatggagacaacaaaggacacaaactgttgacgctatctgcagcctatctatacgagttggttcagtgacagatgacatgtactatttaccatcatcacttatcaaacatcacatgctcaatgattgcttcccttaggtgcaatatcatacatcagctggttggtttcttaggtgcatgtaccatgcatgatgaatttttttgctcacgcgagagttcatatgctcatccaaatgaattttgtcccaatctcgcaccataagcatgcaagtaggctaagagtggtaaaaattgtgtcattatttattctaattgcttcatacatatgtgttaaagtatcctatttaaatttctatatttacactagatctaccaacccttgaatacattccacactttattaattgtggaccagtctaaaatgcatgtgccatatgagggtagatggcatcgttttcgcacaaggatgccataggcaactatgagatcgatgggctacaattagtcaatgacccgacaaaatcactcaaaaaagttgctcaattatttcgcaccgttcgcttttgctccgccattggaacaattcccaaaaccaattcagagcgagaaaatgcgaatacaaaacaacagctgagtggcttcttgagttatatatgcgagttactaaagtacttttgttgtaaggtaggcactcatacagaaactctaagcagatcatttaaactaaaattggtcttggtgtcctgtagccccagttataaacttctaatgacatactcaactcagatagttaatacctgacttcatttaaataaggtcttggatttaaatcctattaagtttcttgggctttcatattgcatgtctgaaactgttggaggcaaatatggaacatcaatgtcgggacaagcagttgatgattcagtagacatgatacttaggattgtaagataaagaaatctccaacaagatgatcatgggatttaggttctacaacaaggcattaattttattaatcttcgaacatggttgaagaatgaagattgtgtgcttatacccaatgatcacctggaaatcgcctacaacaccatggaagaaggtaacaacattgtcaaagtgatttggatggaggactttccggcctactgattgtcaaaggtaatttgttgtttccctaacatcataatgttatgagctattgtgctcacttatctgttgctgctgctaaactcaacaatgcttattcagcgtgataataattgtgttcaaattgacctacttaccaaatcttgtcaaacccagttgaataggctaaaaaagagtacacttgagggagtaagggagagagtagatgaaatgaaagtgatattacaagggttgcaataaaacttagataagaagagattttttttgttagtctatcgagatcaagccctgtgtcaccctgtcctctccctctctttttccttcctcattctcctctacttatgctcttctcatcattcatctcttaaggtctatctgggtggggtatatcaaattatgagataatttaatgattttttttagaatcatttatctaaaaaaataattatggagaaaaataatttgtactatatttgattgataaaaaaattatttcaaaaaatgacactaaaaaaaaaactactatatttagttggaagaatatctatataggaatattgccatatctacaaatatactcttcaatataaaatatttttttaatattaggatagtattatcatctccaattagcttttatgtaatgactaatcgcgtagccctttacataatgtcatctctatcttaatttttttataaaagctctttattgaatgaatttggaaagatatcaaaaaaatttaatgactatatacacagctttattagggatatttttatcaagtatggattatcactactcgagattttattaaataccaattctccatggtatttgttttaccttctctctctaaaaaataaatatggagcccaccaatttttttatcatctctttcctctatttttcataccaaacatagtaatctgatattgaaatcatttttctatgtcaaattacctcaaaccaaatggtgccttagaaacttctcaaatggattgttgttctgtgtttggttgggatcataaaaagaatgattgatgggattgaaagaatggatagtttcatccactgtttgattcaaaaatcttagaaaggatggatgaaaaaaaaaattgcccatccaccttgatccaataatttatatccttccaaataaggagaatgtaaaaaaggatgaatagagtaatgaggaattgaggacagatttctatattgataaaattacttcttattaactatttgacaaaatctaaatatttttcacttctttatctactttatttatagtttctatttatctatactatttatcctatattatttattttattactgattatttaattttaacacatgattttataattatgaaagattaattaaaattatttcctatttttatttttattcattatttttagttaattatttgtataaaactaatcaacaatttaaattaaattataaattaattaattatttatgtaattaatatacaaaaaaatttgttcatatataagtgattaataaaattatttattaaattaaattaaaaataaatatttataataatttatatattataaattataaagattataatttatatattgctctacttgtttagtataaatagtattataaattaataataacagtacttttttaacaaataatagttgagtgaaaatatcatactaatatcatcttttcttcctttcattctttgtataccaaatagagataggaatcattctcatccatttttctatatttcatcaaatttatgaaaaaaataaataaataaatctgtccatcctacctctcatctatctttccttccttctctatctatcattcctccaatatatgcatcataccaaactaagggtttttttttttttgatgcaaatactgaacaaagggttaatgatgaagtaatgcacctgatactagtaaaagaatcacagctcgccttttagccaaacatgatttctacaaacttgaaaaacaaatatgagacataatgcaatatatgatctttaaatgggcaattgaacatattcagctaacttatgttgtaattcatgcgaggctggtagacagggtgaaaccatgttgtttgctcaattatggtggggtacacccaattggattgcttattattggaccttaatgctcttttgttcgttagcggcacatcagcgaatctaggatgcgtggccgcgcatggtccatccagcacgctgtactccccactgtggttagaaaatgaaagacctcaaagcgccacgagggagcctatggagagcaattgcccttctctacatctcttgtcattggcccaagctctcacatcgtctaaggctccttgtcgtaccagctagagataccaggatactactgggaagtttttaaattatttctctcgccttctcatgttacaaatgagagaaacaaagcagcaattgaatgacctcctctccatcttcccttcataaactctccgtcatcgatgttggtatctcatggcaagtgatgagtaaatacaaattagaagactagcataacctttttacaattctatcttgctaatactgtgcacgatgccagcgttggagtaaaggtgaaactgtggtgccagggactggtggacagtgttgggggagccccagtgggttcttttttcttttgtttttttttctccgctccttgcccgcctccattgactccttcacatgttgcttatgcatagctttgcgattcatgttttcctaaccacgtgtctactgaagccgcggtgcaatggttaaacagcacagagcggcgcagcggagggtagcccgcgcgtatgggtaatggatatgggcatctttgcatgtccagataacctccaatacgagtgatcatatggagatattgtggaagccataaagatggacaacctatccgttcaaatattgaggcccaactcatttcaatgttggaaaggaataaaaaaaaattcatcataactcgaaaatctagagagagagagagagagagagagagagctgctcagcagtcttacgccactcattttcctttgccatgtggcacgcattagagtagcccttcaaggaagcaactagaatacaacaaataaactgtatgacttgaatgacttgtggagttaaattatcgagctactgatatatttttataaaaataataaagcagaaacatgcaacaacttcaatcccacctaccaactagggttgcaatgagatcgggtcagataaggacatgtttggctctgtcttgatccagtttcatacatgggtcttgattttggagcggggcctaatcctgatctagatcaggtgagattcagatctatgaaaatatttttttagaccaatggattgttcaaatcgaggcagggttatgcatgatatggacttatccaaagtattagggtccacatcaggtctagacggacctagcttagtttcgtatctatttattttttaatgaaccacatttacatttgtttattaacaagatttcataaagaaaattttgttcttgtctttgatgagtttttggttgtcacaaaattatttgttaacatggtcgaaacttcatggattaatgcttatcgtgatttataatatgctccaagaagttgataacctcgatttataatatgcttcaagaaattaataacctcaacaactgatatttcttaatgtagtaagattagcttgaaatttttctcttaacaaagaaaaagaaaaaaataaatcggaataccttctgtttggatcaattctaattggatcaagccaggtaactaataagaagatctaaataaatccatatagtgcatggatctgatcagataaaattggatcaaagtttataaaatctaaacctaatccagaaaatggaacatatctaatatacttccatgggttttaaaaaaatggatcagatacagtctagctggatcggattgcatcacaagtcaacctcacctgtttaccgtcttaacggcatagggcctcacttttggtattaactgaagtccaaccgtagattgttgtgttggatggcccccaaccccatcctgaacatcaagttaataaataatcctgatgcatgcacggcctaggattgcaactgttagactcttggaggatgttacggctactgtgcgtctcatggtgcggcatttgctcttctataatctacatccaatctttagggttgttttgcaatgattggagtagataagcggctgctccgtaccattggacgatgacatttatgcacatgtatcggcacaaacttcataagaaaagtcacatgatgattgaaaaaattgtagtttttgtgggcagctatgaatgggacgctttttttttatattttttaaacctggaccacttgagcagtcctatagttgttctcaggttgccatcaaagcttttgccatggataaagattgcgtgaccctttaaataggcatagatattctgctccctcgtaactgaatttcataaacctatgggcatgtaacaccatataatttcaactacaatttttcaaaattttggttaggattattcaagtgatgggagcattttatgtaaaggataggggttgtatgtttcaaatagaaaaaaaaagatttatctttcttcatgtgaatctaccattggatcaccctctgcatagatctcaaagcacttcaaattttattaatcacccatctgcatagatctcaaagcgataaatcggtaatccaatgatgaattcgtgcaaaggaagataaatcctccttttacgcaaaagatacaactcctatccttgtgtcaaaggtcaattgggctatgataggtttttactagtttataaagttttaagtcccatttaaaggtagacatctgcatatgaaagtggatctctgaagtcatacatgtcatattaaattcagtttctaagaatttgggtaccattcaatatggctttggacctatcagtaaagaagcctttagatatattcacataaaaattatatgaatgatatgttctatcaaaaaaaaaaaaaaagcctccagcctactactcagcaagtaaaatcccaaactgcccaaactctaattttgtatcttatccctaacatggattgtgtcctaatttagtgtatcaattttcaaatttttgaagtagaacaataatggtccggtaaaagaaaaactaacacatgataatagttgcttttcagtctacctttgtgagctccctttggctttggcatggacctacatggtgatgtgagcagcgactgataacttgtccttctttaggaattgcaaatcaagagaagcgcacaagattaaaaaaatatagatttaattaagtaaaaaattttattttttttgaagattttcaatttcatcataaatttttatttagtataattagatcatcgaatttttagattatttcaattcagatcctgattctaatttctattgacctactgcaatgagttattgcatgacttacttatatgacatcaagttgcttatatagcaaaaaaggttgacataaaagcatccaattcaaacaatcaaaatctcatggtgaacaaactatgagagaagagatcaataaaaaaaaaaaagacaagagcctacaaatctgatttctcttggaaactcttaatatacttgaaaaatcctaaactagtaccaccatttctttctctaccaaacaaacacaacaacaagataaaatagtagaatagggtatggagaagagaccaacagagaactaccaaaaactaaattaaatagaaaaaaaaaagatttaagacttgaagagatgaatggattagattggaagcccacaagactagctttgaggagggaataaaagatgtagagcttatataagcccaaagtattgggcttttaatcgggaaggcggtcaccttcccattctagccataaggaaatggtctaaaagagacgactttaagaagggaggggttgctaaccaaaaaagggatgaaggggatcttggatgagcgaaggagagagtttctcctattgatgagaggcgagtgaacagtaaagtcggggtgaaagaggttggaggatatagaattacattaactttgatctctaccaatctaaaaattaaatctcttttgttttatttcaagaaggtagaaagaagagagtatataaatccaaagggagaggaattgatagaaatcctatacagaaggagattggagaaaggggagagaaggatttttagaatttttttttcagatcatcaaaaaaaagaccacataaatagatcacatatattatgtgataattcaataatggtagacagaaattagagtcaggatccgaattaaaagaatttaaaagtttgataatttgattgtactatataaaaatttaggatgaaattgaaaatttctaaaaatttaggattttatgtataatttgatatcattttatttagtttaacctccttacaataataaatggataacaaaactggtagcccaggtggattgtgatcatggctgtccatctctcagggaatcttgacaagctggcaccgatcaatgtaatagtacacatcgtgtctatagaaccccacctaaattggagttctttacccatgtaatgcaaataaaaaaattttttacaaaaatgatgtgtcttcatacttatttactaaattgatacaaaaggtaaaaataccatttggaatgacattttctatctgagaaaaatatcattccaaatagcgctttctatctagtcaacccacctctctgcaacctatatggaacaaaaaaaaagggtgcttgaaagcaccattttgaatgacgcttttaggtctgtctcggcacatacctaacgtgccacaccccaacaaagtttttaatcaatttttgattttaaaaaaatctaaaattttctccaaataatccacaatcttctctgacgttcttaagggtaagatgatgaggggtggaggaaatatggcaagtttcagagatatttggagatgcttagtgaatatagggtaaaataatcacaaaaacttgatagatatttttttttgttagagcgtgtctcctcaactggcaccttaatataatatgtttctctcatacattagagaagtggagctaacttgtgaaagcttattctttgctatttcaagggatgtaattgaattactcaacatgttattattatttgtattttgatttatatgaccattttagcgtagcattttctcttctaacatttcgagacacacctgaagacctatatccatgtccaaaaatttcatagcatcccaacacttgaaattgacaagcaaaatatttaaactaatctccaatagaaatagtaattaataatataagatagaataaaaatatcaagtctacaaaaaaaaattcgacattattacaagtctaaaaaatacaaagtaccacaagagcgttgtggtgctcgtggtcgcttagaccttctcaagaaggtcctcaatgattgcttctactcctatgtcacctgtgatggccttttctctatatcaatggacgtcttttggtcatgcatacgaggaagaacagatgctgtcggtgttgggaatagtgtcccaaagccaatcgtcagcctgttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcggagcatctacgagctaagtgattctcttaaccccctcatctgaatctaaggatgggcctgtaataaaagagtcacactgatagagaactagaatagttcctaactgcttagaccactcagataaagactcatgatgccaattgggatccagtgctgccatctgagacacgtaggaagataaagatcctaacatctgtggatcataaagtggtgacatatgtggagcatgcagtaatgacatctacaaaatatatggtgatggcatatctgaaacatatggtgatggtgtatgtctcatatctaacgcatcggatgctccatgccaaggcatgataatatgctcatagccaatcaccattaatgtccttaaacataatttctccatctctcacaatatctgaatccactcgtcttcatcggtcgtaaatagagtacgataaatgtctaacataagattcataaaatattcagtttacataacaaaaataaaattagcaatacattatagaacataaaacaaagatataacagaattacataaaatattttacatcagagatgggcttaccactatctgtatcgtctctccctatctctggtatccgagctttaaataatttgatttgtccaccactaaacagataatctatcgataccactctatatactctcgatcgtatggaatgcccctaaaaattggctcaccataaataataaaatattgacgatcatgccatctgtcgatataggtggcatatgtagtatcataaacagtattggacctatctagtcggtctataccataaagagcaagttctgtgtcgcatatttgtggtatcgactaacgtagaccaaactgtatgagtacacggtctgaaaaataccactctatgacatcaaagtaaataagaggcacctatgccatccaaatatcttgtccatcagtgcacatgtctgacaaacactccataacatccgatgtgtaaggctcccagacaaactaaaaaaataaatatatctctattaataattataagttgaatattacttcaagtatttttgaaattatagtcataaatgtgaaataagttactcatctttcaggtcatctaagcagtctaactgatctctataagcacgtatgacatggacggacacatctttcacacgaaacagaacattccacctatagatattgttattgtaatttgactataaacaattgtaaaaataaaaatataatgcttattgttgttacttgaatcgatcgagatcgaaagatggacacctggtggcttcaagcggggatattggtgctagagcgacctacaaaataagtttcaaatcggaggttgtgacttcggtgaggaccttcagatgcttaagtcagaaaaacaaaaaacaaagaagcagcaacgaattctctgagaggagttcgattgaacttatctgaatcctcagggctctgatggttttatataagaagatatcgaacaactggttgcatagctgtgtgattgtgcaatctctagattattggaccgttgaaattgccatagcaggcgaagtaattcagcccttgattgcttccatgagattaggagagactattacatcagattattatctgtttgggatggacagctgtcacacacacataatgaagggataagtcagctgaggtagctcatgcacagatcagactttgtggatgcctcagctcagtagggagactgactcctcagctcatacgataattagcgatcgtgttgacgattcgagagtttgaaaggccttacaatgcagtgccgatctgaggtactcacggtatcccttgtaatattatcttcctactcccaagtctgagaatcagacgaagggagtactccaagagtcgtgcttcatttgcatattaattgcagttgatgtgtattgtcagaggactagcgtacatgcgacgcatggagaccgcgaatggacatgattgctactgccgatatggtagttaatgccagtgacagatgaatcacactttatgctactttcgaaggagtgcatacagatgtgcaccagttgctcccacatggaggccattcgaatttcaacctttttcaaaatccatacaataggtatggaaattcaccctagatcataattagggctgacaaaatatgacccgacccgccaacctgagccgtgttcaactcaccataaacaggtttggatttaggctaaacaagttcggatcataaacggatcaatccgtttaacccgtttaataattggatcggatatggattttagatatctgatctgtttaacccatttaatatttagattgggttgagtcagataatctattcaacttgtttaacctgtttaacccatttctgatccatttaacctaatctgtttaacctgtttaggatccgtttaacctgtttaaaacttgtttaacctatttctgatccatttaacttgacctatttaacctgtttaatccgtttaacctaatttgacctatttaataaacagattaaacagatcgggtcgggttacctgtttaataaatagatcgggtttaagtttgaatttttgactcatttaataaataggtcaggtttgggttgattattttctgatctgacccatttatgacccaacccatttatgaccgatccgacccgtttgtcacccctaatcataaagtgaattataatctcttgcgattctaatcgcaacttgagtcagtttagattttagcttttctttcagctcgactcgtgccttgcttgaagcatgacatgttaggtattcacctgggctatgattttagtttttatagttatagtcgagggctgagcatatattaaattctttcacacatttaaagaagtacgattcatatttatcaatagaagaggattacatttatttctgtgaagattttattacaagactaaggacctcggaacataaaaaaaaataacaacaacaaaagaagaggagagcataaatcattcttcagggggattgtcagggcagtcgtctgtaggatggtattcctcagtgcagacgatactttcgatctagacgactacatcggttttgtccatctcatctcgaaaataggatgtcttcgtgaaccttaacaagttttcaaacaatactgtctgcaaatcctcatctagacaatcagtttgaagctgctgaataaagtcagaaggaaggtacgcctgggcaacggacttgcacttctcaaagcccacgaagaatgctgccctgcaagctcgggctataatcttaaccctttctttctccaactattttttctgctttcagcatgtttaagtaaaatcttcttatctatgaatttatcttaaagaagcttgtgatttatctttctatctttcaattttttcttcaggtgctccaccttcgatccagcttcctggattcccaagagtggttctggggaggtgaaactcccttagaagtagaacgtccatctcctcaaaaagctctctctctacgacttgtcccctcgaaagtcctgatcctcttggacggacccccattggtgcttctttgagaaaaagtttcaagacgaggagagcctcttctcccttcaggtgccctccttagatgctccaagtcgtcacaggcttggcaatagtctctcttagcctcaaacttttatttctcaagagttctaatctgcttttcgagaccctcgatctttttgtcatccttggattcagtcgctcgaaggccatgatctttctttcagcccgccccagtttctcgtcctgatggaagatttacttttagacctactggagagcctcctcagtaaagttaagtttcttgaccagctcagcattattcctctctagctgctctgatcagtacttcagcaagtcgatctctttctttttcattactggaacgtcgagattgaaactcgcaaggcttgccaaatatcggctcacatgtgcaaggaaccttgaagcaatgacaaattacttctctcccctttgatcatcaagaaatagcctctcgactgacggtaggagattccttaggtactccactgtggattggagtttctctcccgcaaatggagtatgaagcatcatatctgaaggacccataggagaagtggatgcaagaaggcgccaagcaagagttgctgtctttagagaccttccagtttccgtcgccatcatcagatccttctccggatcgtcaatcgccttctccatctgcgacatctcagccagatcctctttggagcatcccacgatgctcatttttggtgctatctccgatggtgccccatcgaccaaaattttttctggtgaattttgcactatagctttcgatgatggggacgtgggctcaaggacaagagtggcatgatcttcttccttgatcgtgggttctgcctcaacaactgcaaccgtaatctatctccttcgagccagaatctactctagcctctttacgcactgtggatccatcctgccccaaagaagtgatgagaaatcaacacaagaaaatctgtggatatctgtttttcaaagtgtgaatttaaaagagaaaaaaataaaaaaccactgcaaaataattaaagatctcgagaggaccgtcgtctaagtggtcccatcaattatgcccattcacatcgcccatatcaagctgacaccacaaaccttaaatatggaaggcaggtgtgaaggcaggaacgctcgacaccgagttcaaggtacttttggagtactttcttcatctgattctcagactcgggagtaggaaatagtgttacggaggataccacgagaacctcgaattgacactatgtcgcaaagtatttcagactctcgggtcgtcaacacgatcgctaattatcgtatgagctaagaagttagtctccctgctgagtcgagatgtccgtgaagtctgacatgtgcatgagctgcctcagctaacttatcctttcattatgtgtgtgcgacagctgtccatcttgaataggtaataatccgacgcaacagtctctcctaatctcgtgggagcaatcaagggctgaattatttcacccattatagcaatttcaatagcctgacaatctcgaaatcgcacgatcacatagctatgcacccaattgtccaatatctttttatacaaaaccaccagagtctcgaggacccaagtaagttcaatcgaactcctctcagagaactcgttgctgctttcttgttctctatttttttgacttgagcgtcagagggtccttgtcggagccacaacctctaatttgaggcttattttacagatcgctccagcaccaacatccccactcgaagctatcaggtgtccgtcttctgatcttgatcaattcaagcagcaacacttataatatgaacttcttttacctaaatcttcatggtgcatctcagacaaatgacatatcatcatccatccttgtcggtctcatccttaaaaattgtcgtatctctggatagaaaataggaaacctctcttatgcccgtatataaaaatatctaaaaataaatcatgtaactaaattatataaataaatatatatatatatatttggagtgctaggataattttggagtgccggggtttgtattttggagtacagacatataataggataattttacataagatgactctcattctccataaatatcaagcaataccttctatttttcataccatactttcttgtatgacactgtatattgaaattgttcattaatggttaccataatagcttcaacattaacatctagatctttctcaatattatgtcggactactgtaccaatcatccttcagacatgtttgtggtctcgactcaatcccttaaataaataagtgtgagaactctcatatcttgtgatctgaaaatatctatacttttttaacaatacaacacaaagtttttatttacatttttcttcattatcagatgatgcgcattgtatgaatcataactttgaatctgactgaactatattgtatatccgatgcttttgagtgtgataaaaaccaacaactctcttttgctcatttttattttcaaacatcagatttatagaaaattcaatcattgatgagtctcaaaactgatagttagagtttaatttttgaccgacactaataccatcatcatcaactaaatttatattgttaaaaaattatggagattcgtgttgggaatagtgtcccaaagccaatcgtcagcctgttaacggttgtgctcctttttatattagtacataaattataaataaataaaaattattttggtatttttttttatcacaaatgtttcatcttctaatgaactcctgtgttgtggtgaagtccttaggactatttagacttgacaaaggaggatttgtcgcttagtccttaaacatgttcgcgaccaaatgatacgttgttaccaaggatgacaacgtttatcgagcataggtcgttgtgtgccatatgggttggttctcctcgtaaccaaagagtgtggagacactggtatggcatacaggtgagatgtaatggtacatctgcactgaacgtgaccaactccggagctatttctgctgtcaagatttgctccgatgggatatgggtataaatatccctccgatctgagaccgccacggagacttgcaagcaactcactgcacttaggcactggactacctgaatttctaattcagtgatggaaggttgctgggtgtagtcaagtacttgacttgtcggtgcgtgtgtcaagatgggattgaccactccagtttaggagctgtgtacagtcgtatttcaatttagcaaaaccttgaccagggtagtcctagtgaggagtcacaggactaattgagttgagcacgattcagatgatatcatcagggttgacagtttaaccctgagtcatcctaaacacaggggtcaaaagggatgaattatacggtaaccatattcacataggttctgaatattgtgattgtgattattcgtcctatccgatcgtcggataccattgctagatggtcacttcgattagtacagaaattggttcctgtgctaccggcttaggttcgaacctgcggggtcacacatattagaggttcctttctgatctgatggctgattatgagtcttatctatctgagactctatgattgagaattaagattctctgatcatgagttccacacattttgggtaccgaggtcaaaattttgaatttgaaatttgaactctttgatcagggtttcatatcgatggtctctgatgcctgattgtccatcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttaaaattaccattttgcccctgcactaaatttttgcttcaatttgtacaaacgaggttcaagttctcctacaggctaatcatcttcagcactatttttatattcatcttcatcattgttactatcctcatcaagctattttttttccgtctcattttcatttgactcaaaacctcagctatcagatttattctagtactgacccaatcatcattccccatttgagtgttatatcctatacttacttccactatgggagaagtcatcgtaggactttgaataatttgataactagggccagtggtattagaatgttattctgtaaatatggcctcaacaccaattgttcgcaccagaggacttgagaaaggtgagaaaggtccaggaatattatctttttaggttaaaagtccactaaagtatccaaacatcagtatcatcatttgagtagtattttcattagtggatacatcttttttttaatatataatttaatatttcaatattttggatatttcaaagaaaatatcaatatttcttagacatctttattgctattaattgaaattaagatatacttgttctgcattaactgtcccgatatattaggagatctctatcttaatttgatttcatatttttctctgtctataagaataccattgtataatttatccaataatttttgatgtgataatgataaagacagcctaactatccgattcacaagctgactatactgtacgtcatcttcatcatattttattatgccatcataatataatagtagacaaacccgaatactagctattttctcaaaaaattctataacagtatcaaaattagaatatttagtattaataattattttgataaaaaattaaaaaatctagattatcataaattaatgtcaagaaaatcatcagtatttaatatattcatttgtgaatttcatcgtctaaatgtcatagcaatatagcaaacaattatttcataactaattttagtaattcaattatccaaaaatatagtaaacaacgttaatgaatacattaattaagtattctgtgaatctattttcttgctaaaatacctacatcaataaagtacacataatcgaatgctatatttataaataaattaggtagttgtaagattaccttagcgaggcacgtcgctgtggtgttgggcagctgcatccgtctggaaatagaaaaaagcctcggaagggggggggggagagggggtcaaggaggaggagaaaaaagctggagggggagaggcgagagagagaaggaagagggcaggaggggtggcatcggatgggaagagggctgggggaaggggatcggatgggaagagaggggaggggcgattgggaggaaagaagaagcccaaaggggcagagggggtgggcgtcggttgggatggagacggaagaagccggaggggtggggggagtgggcgttggcccgaggagagggggatggcggggtgggcgtcggatccaaaaaagatcgatggagagcacgtcggatggggaagatgcaaatgatgtggggttttatggaggcccgcttagaagtgccattcgaaatggcgttaatggagcgccattctaaacggcgtttatagaggcatcattttgaatcaccatttcatgggctacatcattccgcctcgcctcgtatctagaggagatgggttgatttaacaggaggtagtgttatttaaaataatattttttgattgaaaaaatattattttaaatgatatttttatttttatattattttgataaataaatttgaagatgcaccgttttatattaaaaagttttttaaccgcattagataggtaaagaactccctgaattgccgaactttttcttcgggacaccgtcacgacttcaccggtaccgccctccggcttatgaaaggaaaacggaaacgggcaagggtttctcctcccctcggaagaaagctggggttccgctgtttcgactgcaaaatgctacgccattccaagaaaatttgaggcttttgtcctccgaatctcttccataggagtttctgttgcttcaacgatcgttagggttttaggaaagaacgcttagtttcctacatggcggggtctccggtacttcttttgttcttatctcttgcttagccttatctgctgcgaagttttcttgccattgatgtcctccaactgtacctaaggattgtctcttttccgcttctttgaaagattttcttcatatttctttcatgtttctttcttcttgcttttacattttcctttattactgcatttctccgatctcttggttaaccttgtctgctgcgaacttttcttgacgttgattccctccaactgtacctaaagattgcctcttttccgcttctttgaaagattttgttcattttttttaatgtttcttttgccccttcttccgatcaatcctaaagattgcttcgtttttggatgatttctttcatgtgtctttaatgctattttctttcctaagttttgcctttcttttttccccttagcaacaacatttgtttttaatcgctgtgattttttttccaggaatggcattaactatgtcggattaatcataaggatagcttctttttcacattcttgagtgatttgctaatgtcttatgttaatgatcttttaagtacgttgtatttgtgatatttcaatatgaataacagagaaaattaccggaaaaaaaactagattaacatcaaaaccttcggagcaatcccaaagttggtttattttttgagttattggaatgatgttaacatgtctttcactctttctttctttcttttccttcaacggaaaccatatgagctctgtgatcctgtgtatgtatcaatattatgctactgtgtgtttatgcaatgtgtcaatattgacagaggagattacatgcaatgaagatctttcaacagtaaagtctactgattactcctgcgtgtagcttctttttcatttcatcgactgtttcgttcttccaccccctcttttatttttatttttttatgtccaccatatgagcacccctcatgattggatttagagaatatagcaataaggtcttggtaagtatatctcatgagtaatcctaaagttggctcttctttacttccatgatgatatttgctattcttttgcacttctatgaatgacattcgtataactttcaggcttctttcattttttttttttaaataatgctgaaatttttgcacattaatagtcctagactggggatataaccctcgatcatttgataagtttgactaatatcatatccgtaaaatcagctactggtatggtacaatcgttgccagtggcttatagtttgaaagtaaccatcagtatggtacgattgttgctgattgcttatggtcctgaacacaacttataatttgaaagtaaccacgggtccatgggtatggtacaattattgctgatatcttatgattctgaacaaaatctcaggcaaaattagttggatgaattttactaaacatgtttcataaatcccactatagagattttttaatcaaatgcactgatttaattttgtccacagatccacatctgggctaccaaactaagcttccaggctatatggtttcttaaaattttgttcgatatgcaactataatctaggattacatatttgtgatacaagctaaacttcactggaaattttactagacatcatacccattagggaatgcctccagcaaacaattctggtagatatctctccatgctagagatggcttggccaatcacaaattatcaatgtcaggatgagaggcagtcatgaaaattttctcaacttgatgcatcatacacttaattcctgaaattgactgaaacaaaaaggcaaaaattggtgaataagattaaatatagctataaagataactatctatctactagacatcaaatttattgttttgacaagttttggtgtcagggaaccccaatagtaatatgcatcatacaaatatgcacttccaaattggtttttgttatatgtgtataaatgaaatttgtcatggcattgcaactttataagatgatatttgctctagctatattgtcaagatcagaatttttggaaataatcaatctgcaagtccacaatatgcatgtgttagaactgagagtgctgacttggatatatattgtaaacttatggtgtatatgagataagtacataagtagtagcaaaaataatgaaggccctacttatgcagtgattagatttgtatgggagagttaggaagatgatgctgtgtaaaatatagatggaacttgcaaaaagggagttgaaagtcgaccatctgaaatagtttaaagaaaagtttttttggttataatgatatgaacttggaaaacatcattagcggaattgtggaagggaataaatggcataaaaattcctgattgcaaatattttcattgaacccaaggtttacagatgcaccttcagttcatcagaatttttggatgcatgtgcatgtattcttttgattattgcattatggcttcatgtagttttcatgttaacatatgcatatgctaacatatgcattataatatattctgtcatgtgctttatatgtatgcgaatggttgttatatcctacatgagatgtggatgactgttctttgtgaaagtgaccagggattaggatcctaagaattcttttgattgttttaggtgaagattggcctcttaattcctcttcaaaagaaccttttggtagattactcagtctcgaatataccaatttttcaaggaggtaatgttattggccgcaataaccttgctatatctgacaagagagttagccgcaagcatgtcagcttgcatacaacagttgatggctctgccgaaattgttgtggtatgccctctattttttgtagtatattagcttaaattgcttctttgcttctatgacttgcgatgggaaaagattggtgatccagctacatttaataattatgaccttattacaggttgggatatgagccatataatttgtaacacattgtatcattctattagagcttatttttctgatacttatatgtctatttgctaattatttgctatttcatttaccctgggattaaaagtggatagatttggaacgtgtttatttattcatatatttaatatctaggtattttaaatgatgttgcaggaaggaccaaatcctgtgattgtaaaatctggggatcaaagaaagaagctctctactcaagacaaagctctgattgttcatggtgacattattgagttgattcctggtaattatttatttaagtatgtaacagttggcagtgagcatgcatcttcatcaaaaacagattcaagcttcttaagaaaagaaaaaagacatagtgtagaggagagttcggctgtcaaaaggaatcggcatattcttgaagatgaagctttggaaagaactttgctggtcttgttctaaacttctttgcttacatgtatccgtgttttggcaacatgttgatcattctattcatttttgaattattaaacttttttccaacttattatggttttggttcatttttcataattctgccgtcattgtttctgagggatgaaattaaatatcataagctaatattgtctagactcttcctgtgcattcatatgcatatgattttacccttgtatagatggactgtagctcaattttagatgaaaaaagatgggaggataagctttaaatgaagtctactggtttgtcccaattaggaaacatgcaaagcttgcctattgacaatccgatcaaattgtatgagaatgtttttttgtctttctcaagtctggtggttatattgtattcagatttatcaatagagaactgaaatcccaaggcttacggacatatcgtaggttcccttaacattttcttttcgacacatatcttctttgatattttttttctctgcattgaaaaatatcatatttttttcaccttttatttatctataagctttctgtatgttgtaccttttaagtactcaataattcatttttcttgttgtatgaacttatcctttaatggtccagtggccagaacattaaaggcctctgtctgaagaacaaaataaagaagaaagatgcagaacaagaaagaagagagaaattcagcaagaggaggggaatatgtacaatttagatgtgtgacaacctgatcctttctctgtttacattagacaagggcatcttttatacataataaggtgacacttatattcccccccaagggagcaggacaagaatatgcatactgtacaagtgatgcctataacaaggcctataggttaggatgcactgtaacacttaatgttttcatgacttttgaatagtgccgatttttctttctttttttttttcccactgaacactttgataccttataggtgatactagttgccgaaagatacctctgcacattgtatgatctcatgttagattttgtcttttaaatcttagtgtattacaaattgttaaaacatttgcattctgctcttctgcatgattcatgtttaaagtgtgccatgcatgacgagaaaggtgcttagataaatgcttggtgcatataagctgtgacttgtttcttgcaaagtatattctagtctttcatgtgcgtgcacacacacacacacacacacacaatcaatgaagatggtcaggagaggagtacatttttttcttttttctttcttttcctcatgtacatcacatgatgccttgacaatctgaaatagtggggggcatgcagggctaggttatttgggattcttttatggtggggcccagcttcgtgctttgagggcggatgcatgatgccagtctcaaagcctttcccattaaatatattggtaaactggaaattggtgttctgggtttggcagcttaatgcactggtttctaaaaggttgctatggcataagtcctctattcaatagtaatgagtgaatcatgttaatgtgatatgacaccttatctgacattttggttgatataggcaaagtatctctttcatgtaatacttaaattttctgtctagaactggatcaatatgaatgacttctaatatcatggttaacattgctgatttttcagcttaaagatctttgttttaatttggacttctgactgctctatatgatcctattgacagacactattttactcctgtacatgcataaactgtacttattccagcgtttacatcatgctaatcaaagttctgttaatcttattaatgtccctcttgtcttatgttcagttattgggcgctgctcaagaaaaattcctaacatctgatttctgattgcttgctttgaggaataaaaagatgcaaaacatattgattaataatttttacttctgttgatgatccttaagctgatataaatatatcattttatttgctatattgttctggttgctattttattttatatggggcattgtgggttccttgtctttcatcaactaaggatcacctgcaagtgcttttccaaacttgttgttaatttccttaaggataacatttgctttcagccaatttagttattttcatttgaacactcatttcactattttctacatgttgatcaggacaatgacaacttggaacaggatgatgtagtggctattacacctggtcattctcagttgaaaccacctgaggttttggcttcttgtgggaacacggaggccagtcgccattttagtgttcctaaggatagactctctttgatctttcgacttatgcgagtccaaggcattcctgcatgggcaaattcatgctcagttgctattcgagatgtgatacaggtaaaatcaatatgtaagagaacaaggcattttcactttcaataagttcagtgacatttatttattgttgttctactctaagactaaacacctaatgttacactaaataggatattgtagatatctaacactagccagccaaagaaaaaggtgaagataatcttgtactggatttttgctattacaaagatatgaaatggttaatttccattggtactgacattattaactcaaaaacagctacaaataaaaaccagcacctagaggcatcatgagttgacttgcaagaacttcccaaccctttttttgatgaaaagtaggatataccatctatggtcttgacatgataaaagtaggcagcaaggtccacaacattagtatcaggtaccatatcggtgtgttactggttcagtacagtatagcatggtacggtatgcattttataccgatctcactttttatcatggtaccgcccggttttgggtcatacgggttggtacagtatggcatgcagtcctgtttcaggcaatacttggctgtatggggtgttctgctaggttggactggtatcgatcgatttgatttgtatactgaactgaacattgatattctactggtaccttaccaagatgggatgcaataaactttggtaggcaatataaaggagtacatgctcaagttactggcttaacaattcattggtgtcatatttctagaagattctgtttttataaaacagtttattttgcccgatccactatcattgtaaaaaactaattaaccaaacatgcatttgcagtgctttggctgagacgatcatccaattcttttcatagtcttgcaaaatctgataagctcaccaaggcatagatctaccactttatttttgttgatgcagtgtgtattgaagaataatgaaatttgctgctaagtttggtagatgcagtgaatcatatgctttttaagatgactcacaactgtaataatatatttgtatagcaaggttcaccaaaccaatatcggaggtaataccagccagcaattggtttggtacatgtctacagtataccttttcagggtgtatgcaaaataggaagagggggagagggaggagagagaggaagtgggagtgagagaggaagggagggagagggagagagagaggaagagagactgagagaggaggcatgccagaatctagggaggagggccaccatggacggggagagagaggtggagagagacagagagagagaaacctaaccaagagagaggggaagggagggggagagagtggaagatggcaagacttacataggagcagtggcagtggttggtaaggacaagatgagcgcgaagcccttgcaagtgaacaagcttgggaggccttttgaggctgcatagtggtggtcggaggagggtttttacaaaccaaggccgaacagatcggagaggctgaaccatcatgggccagctttggtatgggctgaaccacccgatttgggtcggtttggcaatccatgactatgtagttttggtgaagagatattgaaacttcaagaaattcttgttaatttctttttctccttagaagaaggaatgtctgtcacagcgtggtagcttgctggttgctacacttgcaaaacaaaagtacatttacagatcatgcctaccaactccattaagaatcaatacaaatgtgcataagttgttcttgcctggactgctgacctcaactgtattgtgaatttttgtaacttccacagcaccatttgccatctaagttttttattttttatttttatttattttttattaatttttagtgtcattatagtgtcagttgttttataaatttgactgaactatgcagttagtttgtgttcaagataagtagacccaaatgttttatatcatgactggaaatcaaaccaaaagcaataatttgttttagttggatgattgatctccaaatgaaccaaatgaaatacacatttatatggtcttgtcaataagtttcagccaaaaccattcctttcacgctcttcagtcttagatatgcttgcctcttataattgtgcaacccttccaattaaaaaggcaggaaaaggatattctcgatatcaatttctttgaagttggtctcttctttataccatctatgctttctcaaaaagagtatgttgaaatttcaaaatagcacaatctctgtcttcttcaataactatgcctttattacaatgttgttaaatgctgcagttgcgtctttattgtaaataacatgtggtgtgtgcttccatgaattgttgaagtattcatgtcaacccaatttaagtccttgccactttgatccaagctccattttattgctgaattccttttttcaccttaaaggacatttgctatataatggaacagggataatgcaattgaatgtcatgatttggtttgctactgattatcatattatatcttaattatattggtgaatatacttgtagttgaagaaccaatgtttcgtagatggaccatatcttgaagtcacttcggaatgatttttgtgaaagttgagaaaatcatatagaaaaaaaaaattattagatcttgtcaggatgtcagatgtcttttggtgttctggagatacagtttcttaactgctagccatttatgtaaactaacattttttttggtcctttaattcattgagcaatttggtagtgggtggaattataggaataatatagctggggcgtcataccttgactcatgttcgactttttgttccatcatggatcacctagttggactcagaaatgaattcaactttttaatcttgttttatgtattagtaggggaacgtgcttgttgctgtcttgtcaaattacatggtggacattgattggttgatgtctggtaagttcaacattatagtaattacactttttttaattataaattggcttatgcattacctattttttaacttcttacattgcttatgattctttccttcaacttatttgctccttgatggggtaatactgcatatatgctatgaatcattaaatgcaaattgttccttaggccgaattaccaatcagaaggtttagtttgtatgaattgccattggtttcataccaaaaatttgaaagaagtaaaatgcctgtgtaaggtgctgtttatatatattgtgaggatggtgttaaaaatattatgatgcaatacttatatcatatgattatttcttttaagatcaagagtttccatgtgatattaaggtggaaatggctgaaatctgatactgccaatatggtgcaaatgtaccattagctaaactgatgcgatacttgagactaactgacattttaattccaaacattcctttggtgcttttagggcatgtacctccaacacgtgcattataggttctccttgagaacatatgttttctcatatttctgtcatttgaaactctgagatccatacttattggggcttttggtttcattccagtattccaagtcataatttttattctcctgtgtggacactttcttgccaagcatgtagtttaagaatccacgttttcatattttgcaggatgtccagatttgaggaaaatccctcacgtgcttgtcattcatggagaaagtggtgctacagttgaccatttgaaagtacctatgattacataccatccttttgattttcatttccttattagcaatatttatatacttttgttcatgggattaacagaaaaatagacctgcaaattggatccttcacaagcccccacttcctatttcatatggaacacaccattccaaagctatgcttcttgtatatcctcaaggtgtacgtgttgttgtacacactgcaaatctaatctatgttgactggaacaacaaaacccaaggtttatggatgcaagattttccatggaaagatcaacagaatttgaacaaagggtcttcatttgaaaatgacctggttgattatctcaacgcgctaaaggtatgttgtttctccttttccacacaagcaaacacatgaaaaggactcactgcaggtgtataaacatgcaaggatatgcaggtgtataaacacgcaaggatatgcacatgcactcatagttgcacaaacattagcttacaaagtgctttgggcactatggagtccacctagttgttgcctaggattcttcttgtctctgcatgctgacctttactgacttaattggttgcaaatagtatatacttctggttgtattgcataagaaatttccactttttgttaggataacttttttcagacattgaaaccccatctgttattttttctccacgtcttctaatttcgtcgtgtgaacatcattgggcacataatgttttttgaattcagattattcagattgctattttcatataattttcctcatataacatctctggcctggagcattctacttgtaacatatctttgtttgtcttccttgatttactaaattaagctgaaatgtttcaagcaaactaattagttccaccaataaatatgcagtggcctgaatttaatgtccatctgcctgtggttggcaatgttaacatcaatccttccttcttcaaaaattttgattatagcagctcaaaggtatcctcccatttttcattctgtagatctaaattttcataaactactttcttggtgttctgagttgcttgtagcttcgctattctaagcatttccatttgaacctatatccgcaaattggttaatgacatgattttgtttataatgcatttctggatgttaattgtttagtgctttttcacttttgctcctatgttgctggtatcatcaaaaaaatcttttgcattgtagtgatggaatgctagcttttcttttttatttgggtcaaatcaaaatttaatatgaatattaatgtttgtatcatgttgagaatttacatgctagttaattcttgcacctgatttctttctctgtactcatgatgttcgtatcataattcataatttggaaatttttcaaattcaatccgccgaaagatttcgactgtggatgttggcggttgggctgtaccaaatagcactattttttttcctatattttaaaaattgttggctgctatgcatcctgtgcttggttcctgtactggcctggcacaggccagcacctgaaaccttgatttatcatttctgggtcgactagcagtctgctttgtaatgtcctcttaattttctggttgcaacttattgaaccagttttaatgtcctttttgttttagcagatcttgtttccaatacattataatgtttattgatagatatgcagtattgcagtatctgctgtttcagcaattcttgaaaataacttgtgtatttgtaactaaatgcggtgcaaatgtgctatttctccttcagcacaacttcttacttttttttaatcaaggaatacatgcttcaaatgctttttgatttattaatagaagaggatgttttagggtattctagttatttgtatttacttgattgttatgaaggatatgacaacattaaatatgttcatgaatatttagtgcagtggctatgtgtgtcaattaaaatcatgaaatcttggtgtctgcagtttgagatcatttaaaaatcacacctttcaaatatatgtttgtgaagtaaaatatcatcttagattaggtgaacagaattggtactgagaaaaaaaaacatcactgtagttgcttggttgaattgttgcattacattaacacatgattttgcgaagtagataatcaagaagcaagcaatcgagggttcataaaccattgggtcctggagttgtctaagacaacagtgagcataatcactatagatgctttcagaatttgatttttgcttggttctaaatcttaacctcttggatataaaacattataataaccaacaaaaacattatgacatcatatatcttgctccctgattgttttttctgcttctaaaggacagtgattgctattttaaattaattcccatcctggctgtcttacgctttcttgtttcttgactcttcatggcatagctaagtctcattcaaagactttttatgttgaacatacctatgtcattttcatctgatccctgccacacttttataaatgaagtaacttcacttcatgtgtcgtattcccttctaacctttcatgcctaggccctcatggtgccaacttcattcatagtgccaggttcacgtctgtaaagcatgtgcagtcacttagtctggacatacctttccacaatgttatcttgtgcctaaatccgcataatatcattgttcatcactccattttctttgtatttttttttaaatatttaagtaagctaaaatttcagagggaatatcctttgcgttcatatgttttctttcttttctacgtctactatgttcaacttcatagggaagtgggatgggtttgatacttcttattaagtaaacactctattagctgcaaacttagcacctctcaaatattttttgattcatcgtcaacaaatgcattgagacataggatgcgtttgatgttgctgagaagaagtccttttatgacttctaaggtaaaataattgcttttgtaaagaataaatatttagttatgtaacttgagatgtgcttatcatttgaacgtaagccaagaactggctgttaggagaagctagaaaaaaaaatcatctaggcttgtataatttgctccatgttttgttttcttgatgatccaagccaagaaactgacacttttttggttccttcctcacccccatgtaaggcaatttttaggtttgaaaaatcttagattggtgattccaaccagttttaagcccaagtaaatcatatatataaatctataagttagatgctggtcccaaacaaagtttcatttgggtctactaaactagaggggagccttcctcctcgacattgctccatagtttgggctggacccatatggtttggcattgacccaaccctagctcaagctagaccaaaaacctgactttgaccaaagaactagatggttggattttgagatgaaaaaatgaatgtagatcaaatggggttctcttctggttaggttggactgaaatatgatcaaacacgacacttatatatataataatagactagaaaaaaaaacaattctgtattatgggaacaccagagaccaaatgctcaaaattgtgcttcttctgtaataactaaatggattttgagatgaaatactgactgtagatcaagttaaggatttgttggactgcaatgtgatcaaacacattcccacgaatgtgcattactaatagactagaaaagaaataattcttcattatgaattccagatgccaaatgcacgaaagttcttcttatgtaataactttcatgaaagtgcttcctttaatgacttgtgaaaagcagaagcaacttcaaatgtacccttaatgttagatcttgttgtaggctaccagatttcaaatgcacaaagtagtgcttcttatgtaatacattcatgaaagtgcttccttgtaatgacttttaaaaagcaggaacaacttcaaatgcacccttgaatattagaccttgttgtaggctcaatgcaatataaatgcatttactactcgtcactgcttctgcatgcatatccttgcgggcctttatacacacctttaggttacctctctcactaacgtggttcatacttctcattagcactcttgtcacatgccttggccaaaaggcccaaaaccttaaactttgcagggatatttacattttcatgtaatctttctgtcaattgcttgagaaagtattgttaaacaaagcgttaaactgaattagttgacagaatttgttctcatctgttttattattataacagctgccccttctgagttatgacttcatagattattgtactttatcaccaccttggtgcagtaaatgctactgttgatgatttctgtactatctatggaacatcatgcattggatgggcagcacataacattttcaaaccagatatgggcattttcagtagtgttcattcacatggaagttttcatagcatctaggtacttgacctagccacttaatcctaatataccatgttgatccatgacaaacatgtgtatgggatatgtgccccagatggaagtttaaagattggagaagcctctgcttccaaggaagaggaatcccggttgtggtggcggggggtggtgggggtgaggacgtacctaagataaggatgctggtcgtggatgtaggaagctggtggataagctgggttagcgactgaggctggtggcattaggagtagtgaaagaatggaatttgggtttggactatttaacttgcattcaggcacttgaaatatacatgtttttttttctttttcattaaagaggagaacattggtgggtgatacagttcaatcaatcgaagtactgatatttgattttggaatataaacttaactccccactccctggttttcatgccactttacaattaggtcttgttgacaaaaagaaacgtaattcagatctctttttttcatggtcatttaacttttagtccccagcctgtatataaaaaataaaacaaatctgcagaaggcaggcttaagtttaaaacattataagtatgtatacagtgagaggaaagtttgtataaattagacactgaagactaaattaaaagaaagccatgccctttaggaattgatgatgtacagcatatccatgtaccctcaatcaaattttgtattctttttagtggagtctgtgtatcctaacattggaggatgtaaaggatccaacacctagagtggtacccacatccagcacaggtgcgtaaacccaagaaagatagtatcttgcccttatgtccttgtagcttgcaattgggtgtcatgatacatctccaattagttatcatcttccttatttccatattttcttatgtaaggtattgattgtaatatcatatgttctcccaagaatttttttccctcataccgagtttatgtttcatttgttcctataccttttgcatgccttgggaaattctcaagttatttgtcataaaaatgcatgctttaactgtaattatggtccatctagatttattcctcaattagtatttcctttttagacactactaaaatgaccttttgattctttaatttgattatattgaattatgctaactgatacagcctcttggattatggattatttaaagcttttggtgcttgatgtgattttttttttttgcatgttttattgtgtaaaatgagatattctgtatttagattattactgttgaacttagcatgtctgttggaatggttaatcttatgttttttgcctcataacttttaaactattaggttaggctgattgcatctgttcctggatatcataagggtaccaacttgaaaaactggggccatatgaaattgcgaggtgtccttgaagaatgtatatttgacaaagaattttgtaaatccccgcttgtttaccaggtattggtgggttaatttttcacctttctgagcatatttttttattgtaacattatgttgtttgtatacattgaattggaaacctgcagctagatactttgcctctctaacagagtgcagatatatcatataccttgagcatggatagacttctaagattttacgttgacatttccaagaacttcctagatagcttaactttactggaattgcattagattttagcataaattagattttagcatgatggatccttagcagtttgtttctgaatctcttaaacctgctgtagcaaatatcttagagataacatacagacagcccaaatttatccatactttgatagagattgatttgattatttccatcgatgcctgaacatgactcctggtgatgctgggttttgggaacacagaggttaatttattgaatgttgaaattaatgttgtttacatgtgggcttggtaaaaaaatattcattctgctattgatcggactatacttatacagttggtgaaatagttcatttgaatttttgaaaaattaacgatagatacattgatattacaggaactggacctgaactatgatgatggcatagataatggaaagatggtgttactttagatttggcacatctctttcattctagaaatgcttacagcttttgttgatttgtattgaattacatgacttcctgcttttagacactataagtaagaaatattatttaaatcaaacctcagaccagtgaaatatatcctctcactggtgaaaagaatcactaacctatttttcactgcttttgtatgattcttatacttcaaatttagggcatcagacgtcatgatataatgatagtgtaactacttccaaacactaactctggtctcgttactaatattctgttctcctgctatagcaccattcatcctaattcgtgtagtaacttgaatttcttatgagttaatttacggtattcctggtgtaaaatgtaacttgtaagttgttgcagttttcttcccttggttcattggatgagaggtggttagctgagttagcagtgtctatgtcatctggcattttaaatgacggatcacctctgggttcaggaaaaccgcttatcatctggccaaccgtggaggatgttagatgctccctagaggtattatgttaaactgtatcaagaatatttatcaatccagccctccattgttttgctatgacttgtttgttcgttactctgactgcattttttgctgctgctgcttctactgttactggtgtcacatgttctccactaccaccattattgttatgcttgtcttttttgagctacctactaggagttaggggttcagtacatcaatttatactcttcctgtctgtagaaatgactgaaaaaatacacaaaagccatgaggcatgaagctagaactctagtggttgtttaatttacaatttttcccctttttttgtaatagcagttgttgcttttttttctttgtttcatatgaattctcttctatattggtgtaatttgacaaattttacatttgattttgctatgtcaaaaatcaaaatcaattaatgatgcttttagttggctgtgatcctttatgcactctttttctcaattaagtcaatgggtaaattgtagttgaaatttcaaaaactgtctatctgttactttgtgtccttttttatgtttgaagattgttctaatctttgtaggtttctcattttgctctctttaggtttctcattaaatattcttgcagtattttacaaccaaaagtttgtcctaatcttatcctaatacaaatcactatggttataatatctgttcaattcagtttgcatgaaattttatgttatttttgcaattttcaaacagttgtctttggaacctagagagtgagccttggcacaatggtgaggaccgtaaggttgttctattgtgacctggatgtcacgagttaaaaacatggaaacagcctctcttcatgtggaggtaaggctgcatacatatgacccttcccaaaccccacaatggtgggagctcgtacactaggccgccccctattgtctctgaaatcttgattattttgtctttgagttttattcttgatgcaaatcactcgtaatagaagttatttcatctattctgatgaaatgtttgatgttactttttctagggcaaaggatcatattatcatttgtaaataatgttagatggtggatccaaatatacttcatatctgcagcaaagtgataacggatctccttagatgagaatagggtgacgacaaagtggaagaaaattgataaagaaacttgattgaactgctaaatggatgaaaattaactgagagaagcgaggaagatggagaagaagagatatgggaggtctctctgcttgatagaaatgaccaaatttcccccgacaggaatgtggtggttagcaatgtgccattgaaaatgtttagccaaatacagtaggctcaaacacttgggtcccagttggtctggcgatagaaaaatttaaatatcagtttttgttcaagctgggacagatattccattgggttaaggtgcagctagtgccatttacaacctacttgaatgcagaagcagattatataatctcaatcctatttgaagagatcaacatgcgagcaaatgcataggtaagctagtgattaggatgcataagttaaaactttagatatgaaaggcatgcatatgaaaccgacagagtcatctgatgacataaataagcaattaaaatttattaatccaaaaattaacaatttcagagatgtattagaggagaacttagaagctttgaaatcattgattgatgttatcttgaatttgaagctacaacattatctccagagcctgtcctcatcagatccactgggtaaaactcagcaacaaaacttccatatcttatctttctgctgcagaaccaaacatgacacggaacaggacgtatggacgtgagaagggcttataagttctaataggtggccgaaggaatttagggattgacagtagatcagatctgttgtggttggactggaattgagactgaattggtttgaaggaaagggctacttcagattttaagttctgtagctgttgaggatcaactaaagcttgttgcacagttttttaaagaggacttggtgagcagctgataatatttgctgtcactacatattaatctgaagctgaactgattgatgactgggttttgccagtcctaatgtatggctgctgttaggtttttggagtggacaaggtttcaggtttgtggataggttggcttgaattggatataaagaaaaattaatggaaaaagaaaagaaaagaaatagataaaagatgaaagttttgatctgacaataatattggaagatttgctcttcctaagtccttacacccatctaacccctcagctgcaagggggcgcatttgtagattgaagtcaggcaatcatccataaaagtctggagggaatgttgttgcgtctactctttttttttttctaaacagaagtttgtctgggtgaggttgggattcggaccccactggcatccaacacccaattaccttatgagctcaactagttgcaaccactccgatttgataatttcagtagacctcctagtaaagcaggaaacaaataagggcttgattgggaaatccagtaggattgtgctcgataatcctactggatttcctgttggattatggattacacagtctatttaagcaaaggcccatatcagcttgatccctttccaacccaaatcctgtgggaggaaaaaaaagacctccataggtcttttttttatcctacggtccaatagacctatagatgggatttagatgaagaccaggacgtgcagcattcgccgtatcgccccatactataccggtatatctaaccgccctgtaatgaccaaccttaccatatcgtactgcatactgatattattgtgggatttcactggtacatggttcagtaccgagatggctaaccttgaggatgggtctttagaaaaaaaggagctgcgcaggctaacgggctcgattcctatcgaaaatccagcccatcctgtttgatttctgaaacaggtcctaaaaggtttattgtgatatatttaacttcctatttgaagattcttggaaatcaatccatagcaataaggagtgattaaaaatgaactaagtttgagttgtaattctaaaagccttcaaaccacaatccaaagtcatccttctgcaggttttggttgtttcttctgaaactaagtgtaaacttgaaggcatcattagttctgatcacttattcttcattatgtttggtggtggggcttaaggggtcattacttggtgcagtggttaagggctttggctgacaagcacaatggcatgggtgcaagtcctgggacagctactttttgtgcaaaaaattttgcttctcccaggatcccaaattgttgggatcataactaggtgatgtttttttctttttaatgtttggtgatggacttcttattccagttactgtagagctggtctaactcagtctgctgattagttggataggtgaaataattacaaaaacctggttgatagcaacaaattctgctcttgcccttcctcttggacaggaaatggaatctgtgtaagtttggtttgttgaatatgattgaacatggatttaattgcatgactatgctatgcttggttctaatctagtgattttgtatttcggttcatgaactacatcttgaaggccctggttgtggtacacatgttgcataagtgaatttaatataaaattattcttggacttcatgcttaaatgtatgactgatatcagacatacataatatgcccacacctacatccctaatgactgttatagtctaagagctgctttatggttgctatatcttcctgcatatgtggtgtcagagtatgcatcgataagatgtgggattcagctgcatatatcatgatttgtggatttaaccctgatatcatggtcagtgaggaccaggcttatggaaatatggcaattttgctactttatatagtatggaatttgtctctgttatgttgcatatgggtgccagggctaatgcttgcatatggggaaaaaattacatgtatatgttgatgctctgcttttggaactcatatgtcacgctggatgttaattagacatttatattttatttagcttatttttaaagatcatgattgataaactcctaatttgcataatatataaatttatcattgtattagtactccagtcctattctattcatagttaacatgaggttagaactttctaacttctgctgcgtaaaatacttaatcttactgggttgttccatggcttgtccatcttgctcacttgctttgatccctaatttttttaatatgttgcataatgtttcagggttatgcagctggtaatgcaattccaagcccacaacaaaatgtagaaaaggactttctgaaaaaatattgggctagatggaaggcaaaccacgtaggccggtggtataccctttattcattaaagatttgacgaaattattggattataattttgaaatatgcatatctgcatttgttaattgttgttgccgccgtttgctcaactattttgttttgctattatataatttcatcctagtttatgcaactttgatcacactgacaagttttttcctcaacgtttcattatggtaggatggtgcaccttcagaacgagttatttgtacaatttcacatagcttgatcaatattctgtatcatatgacaaaatgaggcagagtgattttcctaaaatctaggggaccatcacatctgttcaaacaaatacacagaaggccattgtttagtttgtaacaggtcataatggcaaagcttccccattttgtaaggtgttaacggttctgactagtcaacttgaaatcatgaaaaataatgtcgataaaggcaatttttttttaccagtagagaaagacaattaagatttgttcaagcttaggctaactgctagtggaggagcagattgcctcctagtcagactgctgtagatttgaggaagatggctcagcaaattgtcaagtaaatctttgagccctttaaagtgaggttttgatatctggcgggcatggttctaaattgaatttagttctggttgaagtactgcctagtttggaagggaagaagaaattgcatttgccacttagagcaatttaatgctagttgacaaagcaagatgggatttctaatgtggagaaggtttgtgcttgccagaaagcttttatacgagacaagtttcaaagttcttattgatcattagcttcactaggaagacacagtatttgacaaatgctggcctttagcgtttgtttatttcatgatgtgcaaaaatagcatagaaacaaatccttttggtaatttaattttatggtgaattaacatcactttgagcaaaatctatggtgtcattgaacttccatgagtcctggagattctgatttcagtagagtcatatttttccattgtttgcgttgaagttgatgctaagttccttcttgcttatatcatgcaggtgtatgtctgaaaactctgaggaatagggagatttagttgatttaagaacacttgttaaacttgaagaaaagttttggctaccttgataataaattttcaatgttatatttctcgtttcaaatgaatgaggataacagactaatactagtttgtgggtattaaaagaaagaaaagctgatttgatgcggattagtgaaattcggaatgcagttttgttattcatgcaattatcagaaaagatagagggttcatagaaagataatggaggaggctacagtcaattatgatcagttcagtgttttgacaatgccctggcaaatggaggggcaaatgagattctgagttctagaaagttttggatctcaaggaatgggaaacttaaggttgtgtgatggtcaaggttggaaatgccaactgtatcatcatgtgctgcatgctatacctctccatattgcatgccatatcaacatgggtgtatcatctatcacagtgaaccatgagtatatgggagcatgccattccttgcagatcctggtacatgaccagtatgccttctatatgcttaggtttcaaaattttggtgttgataacatatgttcggtaaggaagttgagatggttctgttatcaacgactttagctaacaagttggagttctcaagctatgttgattagataaagctaggcaaggtgtaatttctagcaatgtcataataaaacctaggaggacctgaagtgagggtaggtagagaatccgtcttatattaaatgagttcatgtcatgataaataggagtttcatataactataaaaagtaaaaacaataacacaatataattatatggagcctggcatggcaggaattgaattgtagtgcataccgttcctaattataagcttaactagatctttgacggtttagaggggcatttttctcttggtcattgatgaagttaatcactttgaacattaggagtttgagcagctttatgaagctgagaagtgctacaggttgactatctatattatgttttaatgtgcttggtcttctggagcatgagattaataccacatcctgaatacttctggaacatgagattaatagccaaacctgaatacttctggagcatgagattaataccaaaacctgaaaagtgataactgatgatcagcctctagagaggtattttagtgagttggcaaatatgagttttacttatttgggcagtgtgtgctattggtgatcatgagcagattgacattagactgatgctatgcagcattgacaatgttgtgaacctggccatggtgtttttgagctcttatcatgaaaccttggcccatggtggcctaatgtgacatttggatcaatagcaggcaccctgttgggcccaaatccaccatgggattaactatatggctgagacaaagcagggactttaggcctaaatcaggctgggcttgtttttgttaatttggggttagggtatggctttcttaggagttaaggccagtttgaatttcgtctatatgcacggggtggtttgacgactctaggaattgagttctagctgaaaaaagtgagaaggagaggaaggcaaagaggcaagggatgagaagatggagaagaggaaatagacaaggaagaagaaagatactaatgctgcaccaccactggtgctgactctgccttctgctaagttgtatcgtgctgttcttttcttttattctattgtcttctctcactcttttccctattctttatcaatactgtttaccttctcccctgctggctaaatgcagagaggagagatacaacaaagctctagttgcaccatgaatggcattgcctcgcgccttgcaacagtcccccccccctcctcttctgtttccccaccttttctctgcttttaccctccatgctcactttggtcttggtggttgaaggaggattgttatttctgctgcaaacagcccaccaccattctcccagtggctgaaggaatgagaaaagaaagaagagaaataagggagaaagacaggaggaataaaaagaatgttcagggctcaacatatcatggtcaagtaaaatatacttctcaggttcaagttgcttgccatggtgcccacaacccctcagctaccatttccccatcgaatgtgttttaatacattgaacatccagtaactgatttatgaatgtgatgcaaattaatgcttggaagctatcacttgggagcaagatccatgtccaaagcaattaatatttagcaataaagtttatccatgataaaatccatattaaggtagctttccattgcgctaaacactttccaaataaagtttagtttgaaaaatacttggaaatgcctgaggtctgatggatagaaaaagaaaatctggtattactagcaatcatgctagcactttgagttggcagacatggacttgattagtgggcagagtttgggggacaaggaatgtcattatacaccgtaaaaggggaaagaaaaccctgcaaaaaattctcattgacctacataaaaaagttcaagcgaatttttagggggtaggaaaacttgtccttccattattcatggttagataacgttgaatctggtctgttttaatgtctgaacattgatgtagagggtgatagaagcatcattactgggagactatgaatcagtaagtgttgaagatgatttgttacaagccttgctaaaaagtttatggcagaaaatggaaatacttccattagtcagtggctgaaatgttaggagttttaagttgccacttctggtccaagcataggcattggaagccgactctatgacaaaagtccctcaaggagtcttaggattcaaggaatttttttaactacttagggatcttcaatagccttattttgatgactacttaatacaaaaatagttgggcaatgtcatttccaatgggtatttatgtgttcagttttggtgagttggcgacataaaacagtgaaatttattaaaagtgatcctatttactgtactaaatttgttagcttttcaaaaatggttcttgtaaaggtgttctcgtatcattcatatggagtgccatgtgttggatgggttgaaatgattgtatctgtgtttggttgtggagcaagtcagattagaataaatgggttagcttactcctaatccactttactccagaataaactgctccatcacacatggtggagtggtttattccaggttaagtgcaaatagtagccctattttttcttcaaaataaactttgcctccaaaaaaagtaggctttatttctagaatttggtgggttaaagtggaataattgagaaaatgactttattcccctccattccaccttattctgcaagcaaaggcagatttgatgtaacatgttaaaccaataaatgaccaaaagaatgtacatgtatacctaatggactaatatgcaatgaaactatacgacttgcaaatgctttacatttgctccttacactgaataattcataacactacaaccacttgtattcttgttccaagttcaaggataaattataatcccattatcatcatccattaaaattttgttgattggtaaatttgaatcagatgcatagccttaattctgttgaaaataccgctcagtttagctcagatatttgttgatggtgtagtcaggaagtaacaaagttaagtaagagcaaataatgtttttggtaagatcattaatttcttaatgttgtttggttaattcttccataaagggttttagtcttgattagtatagtttgctgctctatctgaacaaatcacacattttttctttatcctcattatgtaattgaaattactgatatcatgctgatgatcatttgtcttttgttacagtcgtgcaatgcctcatataaaatcttacactcgttataatggtcagaatcttgcgtaaggcttcatctctcatcatttagtttgtgtatagcggatatgtttttaatttaagttcttttaatcatgttctgttgagatagttgtttgttgtttcaagtatttcagtgtgatcattattgtttcctctcaacagatggtttctgcttacttcagcaaatctaagcaaagctgcttggggtgcattacagaagaacaattcccaactaatgatacgttcttatgaggtaagcttttagctttaggtactgtttgagtttcttttagatatttgtgtcatttgggtcctgcagtatctgctgaaacttcattagttcatcatttcaatatcattagcattgagcatcaaggaaagcatttcaaaaccagtaaaacagtacttcaatgttcttatatgtcttatatataggtaaactatacttcgtcacaccggaatgtagttagctgcatgaatgctttattgttctagttcgtacttctagtttggcatttcttatcctattctgccttttaaatctttatgcttgaatatttgaatagaaatttagtcaacaaaaatctttcatttggaagttacgtaattcttggcttagaaattaaatgtcttcttcttctattagagtcatgtttttgtgaacatttgctgcaggttgtcttaaatttctggatgaagatacatatattaattcttcagattttatttcaagttgaaataaaacctctttttctttttttctgcttgtcttagagatttgtaaataaattttgtgtgttgtattcgggttgattattggactaagagtccagctgaatctaagaggggaggtctaggtggatcggtgttttcctctaatatttggttcatggtcaaagagaagatttaactgctccattaattggttttaaatgtagttaagatttaaaaattagataactataattaagaattagcttctgataagagtctggataggatccactcaagtgcattttgccgcaaatgcttcatagtggaaatcaatgatagacctttcaaaataaaagtcaacagcgttgaatatgatctgtggtgcataaaacacgtaaagacaaaagatcacacaatttcgaggtatttttacctagtaccagatcgatgaaaaatagacaaatttaatggtataatgccatgtcttcatttgatctatagtctagaagcatccaaattatttgatatttggtctgtgcatatattttgatgtttttatatcaacatcaatggctaatatttacaaaacatagtgtataatatgctttaacccattagaaatattgctaccgtttattttgtgctcgcttgatgcataggcaagatacctcgaacataaatgactttagcatttgggcattttatgcaccatagttcatgatcaatcatgtcgattttcatttgagaggtgcatcatcgatttccactaggaagcatttgggtaaatgcagttgagtgcatccttgcccaagtcctaataatgtgatacattctcattttagttgaaaaatgtttctacgaaaaacatatggtattgtgcatttatagtttgttagaatgttttatcagtggcttggggtgcacacaggtatggtcaggtcagtttggagataaacctaaaactaaactgatttaaattagtttcctaaaatcaaaaccgaagccgaactatctacaaaagccaattgaaactaaccagggaaatttgattcagcttagttcagtttatccggttgatgttcaatggtttaagttaaataggtgatcgctgtcataggcggtcaagaataaaaaaccaactcaaattgtatagatagggtgagtcaggatcgttttcacagggatttagggcgattgttttttctttttgaagaagaaataaaagagaattgatggtagaaagattaaaaagaaataaaatagcaagaattaaattgtaagtataaaattaatttgtgaaagaaaacaagtcagagagataattcagaaattccgaatccaccatgcaaattagatttttttttttttttatgttgcaatattaattcttgtgattagggcattagtatagcttatctctaaggggtacggactgtatcaatagatcatgactcatcctattagagtataaactatctaaatttaattacaaggtataaggtttaatctaacataccacgatctatccctcctaggcacgtaccgtatccagggatcacggcacgtctgtagagggtataggccgtataggctggatcaatacctcagaaaaataaaaagatttgaaataaaagcacaattttattacatgaaaattaaatacaagaaagaaaataaaaatccgtttacaagcttcatcatattcctaggttgaagggatttagccacgcatcaagatctttagctccatattctcccttttttcaagatccaaaaataaaaaaattctgttctgcttccgctcctctgctctctttgcttccgctattgttcgcttgatgcttctcttctctatctccctttttttcttgtttctgtggacccttttttataggctttagcgtctccgagttataggcgtatctggactcttgattcctcacggagtccttatttgtttcggtttaaaaatcttagccgctgtttcttgtctgatacacccgatgccactagcttccagtgcttcacgcgggtcctgctaatttgaattcctgtgagccacgtccaagcttttgaatccaaaccttcctccttttttaaatcatttgaagcttgctttaaatgccctgtggaccctcctgtttgcatgctacgtgagaacactgttgagctcctgttggcccacttaagaacttatatgggctgcatgctttgggttggcttttagatggttttgggcctatctttggatcaccatttggatccattagtccattttgcattcaatttgttttcaattttcttctttttaacttgcaaatcagacttttgtattggtgagtgtttttcctgcaaaatacaaacaaaaaacatcaattcttaaggaataaaagttaattagtatatattttgatgcttttattgggatatttaatgtacttatcacatcctccaacttgagctttgctcgtcctcaagtaaagaaaggatttagtactaagtaccatttagcttagagtttcaagtttcactagacaattttaaaaagaaaaaaaatcatggatgttcagtagagcatgagtgacgtatgtcattgggatattagtactaatcaatagaagttaagccaagaacattaaattttttcagaattttttctaaattacccatctttatctctaaatcatctactttcatatgggtaagtgtagtattacttccatccttcatttattgattttttttatttttttatttctttaatgttgtaccgctattgagtgtcttaaccccttatgttttctgtctgacccatatagtgagttttcagctaatgactcccaaatcagttgactttagggcactaagtataaaatatcccttggacttgctcaaatcaaataggctatgagttaagactaactttacaataaagtttcattgtccttcatattttttgacgcgaaactcaatgcttgcttaggcaaagaggcccgattactcagcataaagtttttgcaattttttttttatgaagaaatgtatagttatcctacacaagtccataggaagtaaactcttctttgacgttggtaggcaaaaaatcagaaatattcaagaaaaaaaaattgtttctattctaaacttaactattcattgaattttcttaatacttgatccctcgatatctcacaaactctttaatctgtacatcaatttttttcaaaataaatttgcttggtttcactcaaatctgtaatctaatcaggtacctaaatgttaaataccaatttattcaaggactttaattaattttttttaattacccttaccctccaactcaattttcattgttctcaatggagtaagaaaaaataaaatagagacagataaataaaataaatagagataccatctggactataagtatactcgttcattgacaggtgcttctacataaagcggtccattattcctaaaaaaaatgaagatcactaaaataaagggttaaaaaaatttggaatgccttccaaaaagtgcttagtttcaaatcttcagtcggactaaattcgtaatacagaatcagtcagaataaataggctcatggagaatcatggtctcttcctcaatttcagtaggcaacttcaagaatgatttcaatcgttgtccatttactttaaaagtagcatcattgtttgagttttttatctttacagccccatgagagaacttcttttactatatagggtcctgtccatctggatctaaatttttcaggaaataagtgtagcctagagttatacaaaaaaaatttttgaccagatgaaaatgattttctaaggattgctcgatcatgaaataccttagttcgttctttgtatatcttagtattttcgtatgcctcattcatgattttctcaagttcatcaatttgcagcttcctatgttgtccagcctcgtctagatccatgttcaactttttgatggcccatatggccttatgttcaagttcaactggcaagtgacatgctttaccaaaaacaaacctataaggagacattcttaagttggttttgaaggcagtgtgatatgcccaaagagcatccactagcttcaatgaccaatcctttctattggtgctcacagtcttctctagaatttgtttgatttgatgatttgaaactttgacttgtccactagtttgagggtgataggatgtggccaatttatgggtaatgttgtattctttcattaggatttcaaatgatcgattacaaaaatgtgttccatgatcacttataatggctctaaggatttcaaaacgagagaggatgttttttttagaaatttgatgacaattttgttattattcgatctacatggtagagtctctatccatttagatacgtaatcgatagccactaagatatattcattcctgaaagagtttggaagtggttctatgaaatcgataccccacacatcaaaaatctcacaaactaagatcggatttaatggcatcatgtctctttttgtgatccgtcctagttgttgataactaatatagcttttacagtattcatttgcgttcttaaacaaattgggtcaatataattcacattagagaacttttgcggcagttttcttggatctaaagtagccaccgcagacttggtcatgacaaaaggataagatacttttgatctcatgatccggaagacatcttctaatgatttggttagggcattgtttaaacagatatggatcatctcaaataaaatacttgggcaaagaatttgtgtttgtcctgagtggttcagtaagagagaatcctaccaatggtcaagtaattgacaatattagcgtatcatggttctttggtcacagacatgagttgttcatcaggaaaagactcttctattgatggttcgttagagggtgcatcaatcaatcgggacagatgatcagccattacattttcggttcctttcttatccctgatttttaggtcaaattcttgaagaagtaaaatccatcagatcaaacgtgcttttgcatctttttttgtcaagagatgtctaatggctgagtgatcagtgtatataatgacatgtgatccaactaaataagatctaaatttttcgagagtaaagacgatagtcaagaactttttttcagtagttgagtagttaagctgtgcatcattaagggtcctactagtatagtaaatgactcgtggcagcttatcaattttttatcctaaaatggctctgatggcgtgatcagatgcatcacacatgagtttgaaggattgagtccaatcgagtgggtgaatgatgggtgcagatgtcaatcctttttaagatggtcaaaagaatcgtggcactcagcagtaaaatcgaatttgacgtctttggtaagaagattgatcagtggtcgagctattttgctaaaatttttgatgaacctcctatagaagccagcatgtcctaagaatgagcgaattttttttactgatttgggtggtgaaagatttgcaatcaggtctcctttggttttatctacttcaattcccttttttgagataacatgaccaagtactatgccttctttgatcatgaattggcattttttacaattaagtactaagtgtttctccttgcacctttccaagactagtcttagatgatgtaggcactcggagaaggtggagccaaaaataaaaaaatcatccatgaatatttttagaaatttttcgatcatgtcagaaaagatgctgaccatgcacctttggaaagtagatggagcattatataaaccaaagggcatacgtctataggcaaaagttccaaatggataggtaaatgtggtcttttcttggtcctttggtgctgtagaaatctagttatagtcggaatatctatcaagaaaataatagaactcatgtccgactaatctttccaatatctggtcaatgaatggtagaaaaaatgatcctttcttgtggccgcattcaattttctgtaatcaatacagactatccagtttggatcctagtcggtactaattcatttacttcgttttgaaccactgttatctctgatttttcaggtactattttaattgggctaatccatgaattatctgaaatggggtagatgattccattgtctagtaacttgagaatctctttcttcactacctccttcatagctgggttaagtctcctttgggggttggcttgacttcctctcctaaatgaatttgatgttggataattgaagggctgatctctttgatgccagctatggtccagcttatggctttcttattctttctgaggatagctaaaagtgtctcttcttgggtttgatttaggtctgatgcgatgattacgggtaggatttctgatggacctagatacgcatatttgaggtgctcagggagtattttgagttctaatttcagtgcttcctcaatcgatggcttgtgtattggttcattaatccttacaggtggttgccattatggatgaactctctgattactacatgaaaaaatttcataagctatttcagatttttggtctgatcagatattacaatcaaaatcttcttcccctaggtcagtggtatcatagatctcatcctagatcaagtttacgtccacgagttggtcccttttgttttcaagattgaaaatattaagatcaatggtcatgtttccaaatgagagcttcatgagtccattgcggcaattgattagggcgttggtggttgctaagaatagtcttcctaaaattagtgggatgtgatcttttggattagacactggttcagtctcaaggatcacaaaatctatagggtaaatgaaattgccaactttgattaacacatcctccacaacttctttggaggtctttactgatcgatctgctaattacaatgtgatttctgtggactttaattctcctatctccaatttttcataaatcgaataagataagatgttcacattagcccctaagtctaataaggccctatcaatgatggtttccccaatgacacaagagattgtaggagatcctgaatctttatacttgacaggcatgtggctcgacaggaatgagctcacactgaccgccaagaaggtttttttgggaacgttggtggtcttcttctttgtgcataggtctttgagaaatttgacgtatgtgggaacttgttggatcatgtctagtagagggatatttactttcatttgtttaaacatctctaagatttgatttatatgggtcgagtgtctgttggacccaagtctgtttgaaaaatgagctacaagattggtgagggatgtctcaacttgcttaaaccttgaggtagattctgcaagtggcttgggtggttcgttaatctctgttgactccttaggcttatctggcttcttagatttggtctgatcgatcacttgctcatgaggttgtttaaacaatgggtcatcttggtcttcaactgtactgacatggttgtctatttatttttcagaccttaaggtgtgaattgcatttaattgattgatctgggctgcttgttgtgatctttgattgttctggattctaggattagcctcgaattgactcggtagtttatctttttttctttcactcgcagtcgtagttaattgacctaactgcatctctaaacgggcaatagtctgggtgttggaagttaaaagctggctcgtggtctgcatgaagttgtttagtgtagtgttggtgttagcagtcgattttactaggatttttagactcttttctagcgagttaagtctttgatcattactaaaactaggagggttaattgatgattgaatggatatggggttgggctgagtgaaggcaggtctacttgagtttgacccttgtaaccaaaaaaaattggagtggttcctccatcctggattgtatgttggtgcgtaggggtcatttgtggcagtcagatacatgagggttgggctgatctaacaggatagaaaaggtctttaaggacccgaggttcatgttcggattcacccattgtggacttaaggtctactggactagatgctaagtttggatctattctcactaatcgattagatatccttgtccaagaagaaatttgggatttttcagttatttttgtaattttttttataaagagaagagggaagagagatagatgagaaaagaattctaaagatgagagcttaaggagttctaaatctaaagacgatagagaagtgttttaattagggttaatgtttgtaggttagtaatcaagttatgcggtcaatccttgttaaggataactttagatctaaacaacttctaattgtcaaggttgtctttgagcactccaagtaaaagactagccactcaactggccaagtaaatgtaaggttggtgggcgtctctccgttgcttttcttagacaccaactgagttggtcaggtaagcgaacggaaccaattaaataaccatctttctttaggacgtagtttctgaaccactttcctagacatcagtcaaactaaccctaacctggtccaactcttaggatcttttgtcctattgagctcgagtgtccttaggggccaacgtctaattgattttaggttaaggtttaggtcaatgcaatatgtaggatggtggtttgtgagccaaggaagggtgatgaaatcttcaccttatcttgtttagggtttgtgctcttaagatgttttatgaaattatgtaatgcaagaagaaaagatggtcagatttggtaattagccaagagtaaattgatttgtttcactttttaggttttgtgattaagtatctaattttctaattagattatgaggtgtcaatgtagagatttttttttaaagaaagtaagtttgactaagtaactaaacaagttagaaagcaaataaaaagaaactaaaaataaaactaaagaaagttttttttaaaataaaaaaataatcgtgcctaaattccgacaacggtgccaaaatttgatcgctgttgtaggtnnnnnnnnnnnnnnnnnnnnaatttagggcgattgtttttttctttttgaagaagaaataaaagagaattgagggtagaaagattaaaaagaaataaaatagcaagaattaaattgcaagtgtaaaattaatttgtgaaagaaaacaagtcagagagataattcaggaatttcgaatccaccatgcaaattagatttattttcttctttttttttatattgcaatattaattcttgtgattagggcattagtatagcttatctctaaggggtacggactgtatcaatagatcatggttcgtcctattagagtataaattatctaaatttaattacaagatataagatttaatctaacatattacgatctatctcttctaagcatgtacgatatccagggatcacggcacgtctgtagagggtataggccgtgtaggctggatcagtacctcagaaaaataaaaaaatttgaaataaaagtataattttattgcatgaaaattaaatacaagaaaaaaataaaaatccgtttacaggcttcatcatattcctggtttgaagggatttagccacgcatttagatctctagctccatattttccttttttcaagatccaaaataaaaaaattctgttctgctttcgctcctgtgctttctttgctttcgctgctgttcgctcgatgcttttctcttctctgtctccctttttttttttgtttctgcggaccctttttttataggcttcagcatctccgagttacaggtgtatccggactcttgattcctcacggagtccttatttgtttcggtttaaaaatcttagccgttgtttcttgtctgatacgcccaatgccactagcttccagtgcttcatgtgggtcccgctaatttgaatttttgtgagccacgtccaagcttttgaatccaagccttcctctttttttaaatcatttgaagcttgctttaaatgccctgcggaccctcctgtttgcatgctacgtgagaacactgttgagctcctcttggcccacttaagaacttctattggctgcatgctttgggctggcttttagatggttttgggcctatctttggatccccattcgaagtccagtagtccattttgaattcaatttgtttccaattttcttctttttaacctgcaaattggactcttgtattggtgagtgtttttcctgcaaaacacaaataaaaaacatcaattcttaaggaataaaaattaattagtatatattttgatgcttttattgagatatttaatgtacttatcaataggctaggcaaagtctaaacatataaattttatattatatagggttgatgtttaatggactgggctaaatggattgggctaagtctaaacataaaaattttattatataagaaaaaatattaaaaaaaaataaaaattgaaatatatatgcacacatacatatgggtcgggttggtttgatatgcgtgcgtacgtacgtaggggtgggcccagtcggatcagtttaaatcgattttctgaaaacccaaatagaaactaaatcgatttttttcagttcaggcctttctcaaatcgacaccaaactgaattgagaaaaaaaactgatataaaccaaaccaaaaggaccggtttgagtcgggttcacagcttggctgattttttcacacctctgtcagtggcaaatagacaatgattaccagagctttttggctaatttttttgggtccttgaaactaggacttgttttggtggtttggccaaaaactaaatcatggggccaaaaattatgtgaatgtgtttcgtcattccttcgtttctttaaaactcaaaaagcattttctcatcaacattaccattaggatatttacattgtcattagacaaaaaattatgtttaaactttgccaattatctcctgaatatctttttgagggacactttatatttagtggaaaactccattttttaggtttccttggacggtaggatatgacatgacgatgttggatatttcacttggatgccttctgctaaaattagccagaaagtgcgtacacttggtcaccctttttttgaagtgttattcaaggctttcttagtttcaagtgttttacgcactaattgaagtgttgtcaggtttacaatataaagttatcatggttatttaacaagtaatttcatacattttaagtgatgttaaatgtgctggtgaattttagattactgacaacgtcatggttggtccactgtcttagacaacatttctttcgtctcccttttagtattccttttgtataagtatcaaaaaaatggtgtatgtctatgtaaccatgcatgcatgcatgtatgtgtgtatgttcatttttgtatgcaccaggtccatgtgtctagatttttagggactgtcatgtctgacgtgtgaatacacttaaaacacttggctcaggtaacattggttgttgtaaaattgtttagtaagtggtctcgcttgtgtaggggtttattggtctaatagttggggttaaagtggattggacaacatctatgcatcagtttttgtatccaattgtatctagatatggatacaatacttgtcttcctaatgaaagatatggatgtctggctgatatccctatacattaaaagaaaatggatatagatatggatagataactatctgatccgcgttggaatatttgatttttttttttttgctatgctattaatctcatatagctctcattaactttaaaggtaaatgagtgacaaaatccacatgtctttagttcaatttatcttccatatactgacatctttaatttggtgggtcataaaatttacatatcagatgtctatatttttatatccatattgttaatatccaatttctttttgtatccatttttttaaaaaaatatggttataagttttagcatctgattagtatctgtatctgtatttgccaaacaaaaatggatatagatgcggatatattgataaaccaatctgtatttggtctgtttttagccccaggcagtgtaagtctataagctgttattaaatttaatccctgctgactgcaaattttatatctggtcctagatttagatggccattttacctttgttccttggtttgtccgtgtgacaaaacaggtatagcttcgtgtatacagaaataggcctgtgtgcagaacccaactctgactacgtacaggtactaaatataaattactgtgtgcaggatcagttatcaaatagcagtcaaacaaagactgggtgttgagccttccatctcatgttcaatatcatctctttataaaaatgtggtacaaattttttttgagcttttaaattaaaatcttcattagagtttatgagaaaaagaaaaaaaagaatatattcacttttctacaaataggtttcaagtcaaaggttcttgttcatatgcatcatctttcccatctttgtcttgcactgaacacctgcttctgttgccatatccacattattctccatgcgcaactccctttcaccattaccttcctctcggcgatgcctgctcgaccatatcttaggtgccctctccaagcttctcacctccaagcctaatgcacttctgggtagggggacagaaggccaaattttttggccaagagctgtcggggttagtgccaggaagcatggacccagcgtccactaataaattatatacagggtatggatgcacccatgcaacaaaacttgaaaattaggatctgtatggctaggataccattatatatatatgtgtatgtgtgtgcgcgcacgcataaaaaggatttataaaacataatgggctatcaaaataatatagtccatcttggatatatcgaacatcaacttccactaattcatcacctattaaatccatagatcacaatccatattctatacttttgtatcaacatcacaaactccaaagtcaactatctatcattaaaaaattaacttttatagaaaaaagagagaaaaaaacctcctcattcttggaggtttctcgagagtatctggagtataattggaaaacatccatttgattttgaaaaataagatacttgacataagtatcaggattcaggtatgtatcataggggtattgtacaagtattggtattcaatacgtatctgatatagacaaaggcatgtgctctgaattatctgtctttcttgggatggtgatgatgtttaaggttgcaagttctgattcggattgtgatggcacaaaaggaagagggaggagtgcacatttgctgatggattggaggagagaaggggaagagctgataggggcactagaggaggctctgttgttggggattgctgttagaggagaggagtggaggagctggaggtgagaacagaggagcaaacaaaggtgtgctggaggtaggaggagttggggccatcagaggcaggtcagggaggtgttccatgggatggtagaaagccatggtgagctgctctggttcttagtgagtgcatacactttgtcccattatctgtaatgaaaaatcaaagcatctggttttgtagcagatgaagagtgagctcttaaaggtttccaatcaacaatcttttgtagttattagatgtatgtgtcatctagatcactttgttctgattggagttcagtgagcaaactagaatattaagattattagttgctttaagaagatttgcatgattttttatgaaattgacaaaggaattttgctactacctctattttggatatctctgaatcagtaaaggctcctgcaactgattgtcctgcagcagaaaggccgatatggttcactgtttcaaaagcagagtggttctatattttttccaatttatatgaatggacgcacatattgctatttttgagcctacaaagtctttattttttttgaaaaatagaaaattagcatgactaaaaaaaaaacttgttttcagggctattttatctaaataatattaattttaaaaaaataacgaaaataatactcttttcaaaatattgtccaaaacaaagtcgccctatgataggacgactttatgtgttgactcactacaatttacactatgtggaaggtggagttagcaactagtaagtcgtcctattgtaaagcgacttatagagtcgtcctatgatagagcgactttgtgtttttcccaagcgcaagcctcacgatccaatcatccctgtcacgacctaaacataactagtaagttgctctacgatggggcgacttatagagtcgctctattttaggggcgacttactaattgctaactccaccttccacatggcgtgaatggtggtgagtcagcacataaaatcgtcttatcattaggatgactttgtttcggacagtattttgataaatattttggaaagagtattattttcataatttttttaaaattagtattatttagataaaattgcctgatttcatacatccaggaaaaaatagaaatagagttcctgtttcatatttttcaatttgaacaggaaatgtgacagcaataccaagcaaaggctatttttgacaaatacaaggaaaactattcttattttgagaaaaaacattgggttcataggattcttattaaataacataattataattcaaacttttatatagtctaatttagtaattttctaatttgtgctattttttgtatgtttcatttattttaaatagttttatattttaatgctttaataattcctactgttctcctaaaaaaaaagcttcatacacacaatgcacccaaagttctcgaacatatattataattaataagtgtcatttaaagcaatttctgtagttttttatgttgatattattttgatgaccgtatatttgtttactggttctgttgatactaccaaaactgtaaaataaaaagtatgtggcatctccaaaccaagacctaaaacaagtttttttatccttgtctggttagatgtgcttcctcaaatttgctagtaatgtatcaatttatagatttctttaccatctaatgctgtattaaaaatcatattcgtctcatctttccagttgggggttctgttcttgccatccactattcaggaccgtagttctgaattctcatgcacagagaaccagatcttaaatcaggtattgccaacatagctggtgtgccatgcttccagcttactccggaagtgttgtcatgctctttagttgactccctgtgaacaccaccattttcttgttcatcattcagggcgaacgcaagtcatttaggaacactgatgtgtgcaagacgaagctggtgaccctctgctggaaaggaaataatggaatagactcgtcttcagaggtgatccgactgcccgtgccatatcagctcccaccccaaccatacacctccgaaggttaggcaatgacaagcagtggctaatctgtctgtgcttttagttttacttaactatatttctgttgtacaggaaggtaaattttcattgtgtttactgttgcttctatccagatatcccctggtcctggaataggcaatattttaagaaagatgtatatggtcaagtttggccacgtcatgttcaactgtatacaaatgaagatgcttgacccctgcaatttttttctgctaaagatccacattcatgatcgtagtcttggttcatgtggaaatgacaagcaggtttagaagctatccttcttgtggtaaaatgcgcaggtcataagttgaattggtgttatttttgacaatatattattggaagtctctgtttaccttatttcctttttattaaattcagatgcttatctttcccttgttttttcggttacgctagggaggaatgataccaaagattaacttgcctaccccaattccaaggagtcaatcttacttcagacattgcgaggatgaatgaggagcaagccatggtaacagtacttcagcttcagccattgaagcagttatcagctagttgtagtgtgactgaggatttgcaggttgggatggcaaagaaatatgtttgctcatcataccatattcatagaactgggtgatgcaacaggacatgtaactaatgaggcacagggctactacactgtccattgtcaaggtcaaagatcagttatcatatgcattcattgatgtgaggtttcttgacacatggtgatggtgcatagatcttcagggtcccatattgcttattgatatttttaaggttctgtatagctgtcagagactgtcaacgaagagtcgcactgaaaagtggctgcacagtaaaatgctcgtttttagtttggtcagttcttgttctctcccgagagcatgctctgcctcaggagtctttgttcttctggcattctccatccaaatgtgttgccttcaaaagttgggttaataccgtgaatcatagaggctgagaaagaggttcttggcatgctttgtacccctaaagctgcaccctttggagaaatgagagcttaagatctgttttctccgtatctgtttaagtttttgcccggccatggttcaaacaagatacaattagtataaattaagatctttatcatgttcagagaacataaagctaatctaatgatctgaagcttactattacttgtggccagctgggatactattagccatgaaggattcttctttcggaaaagaaaaaaaaaaagctaatttggatttttattgtccatatcgatgctcttgttgcggtggatgattgactcagacatcaataactatgttctggcagaaatctttgcgagtaatctttaaaaagaaaattttattaattgagaatattctttcagctagtttgcaaaggaaaaaagggcttccattttgaaagatgactgggtttcgtattttggaggtgctggtaaattcttagatgaatagtgtcattgccgtattaggacattcgggctacaaacaatggtgttgaatttcttacagatgggacaactgtctcacatccaatgtttcctaagatttggaatctgctggcttcggttcatcaaaatacgtatctgtcgtttgaatatgaataaataagaaaagttgtggctgttagtgattttagagagatcacaatgacaaagtgtagatattttgcacgtacaaaaccaaatgttgcaaggaaatgaaaaaaatggaggtttattttacattaatagaaaaaagaaatgagaatatatagatagtggagttgttttttttttcaataagatggattattcatataattcttgtgtgaatgcattcagaagtattagaaaacaaaatatccctaagtaagctaggggtccatctcatgttagtctaaaagaatggttttaagtgctccgcaacaaaaacaatcatccaattggcagttatgttcgtctttcgaaagtgctccgcaacaatagtcagaagagtcaatgtcttgttgacatcaccatgaatatacttttaaccaagtcataatcatggtcgagtgatccttaataatcagatagtcggcacaaagggttcgatgtgcataagtgatcttgatccatttagtttaaagctctacgacagggatcgggggcccaaaatggtgactgacctcaactactactagttttgaagcatagtcacaaatcataaaagcagcatctccactcctatccttgacactaccatcttgaggaacatcggaggagggggctcttaggtgatgaaaagctgacagatcattgtatgagcaggatgtaagtttcagatctctaagggtctcaaggtcgtatcaatcacctcagctatcgaggtcagggctctctctaagaccaatcttgtcaaacacttcctagcgtcaaacatcaggtgattcctagatagctagatctgctgggcaatatgagttgctcggatgccaacccttctcaacgttatcaccctagcacaccgtctcagcaaatctaaaaactccttaactaaagtacctacctaggaggtaaagctatgcatacttgtcaaatgccacacctgcatagctctcaaacacaaaaagagaacatgctcaacggtctcatcctccctatcataagtcaagcaaacagactagagattcatgtctctctcccttaagacagacgaggttagaagtcaactccagacgactttctagaggaagagactcacccgcggatgcactcaaattgtccaaatccacccaatatccaaatgcttagtaacctcattccagtattggtaatatagatcaactgttatcattcttggcaagcaagaagatcttcagactctaacatcctatataatgtgaatcggattgccagagactgcacacgttctgtcaagtgctcctcaaacagctaggccactatccccaaatcccagcctctgccatcttggacgagaatgtcatagaccctcagcgagtccccaatctccgcaccgataaaggtgggccaacgactcaatggcacattagcaatccatggatccaatagaatgttcatggaccagccatcccccacaaaccaccttatttggataatgacctcagaggcctgtgcacaaatctttttccaccaaaaagagcagctctgactcacatggatctccacccctatggcccatgaaccatacctagcccttgttatcatgctccaccaactggtggggtcaagtagaaattgaaccacatgctagacaataagagtctctcacctaccaaggattggatctccagactgtcatccattagcagttggcacacaacatcctaggccaacaaatgcacaccatctccttcaaaactcgagccccacaaaaatctccaaaagtggtgcttgagcttcactatcagggtcttgggcaagatcgtgtttgagaggagtagacagatatggatctaagcactgatctcatcagaataagcctacccattatggaaaaagctctagcttgccatctctcaagccgctctcaaatcaattgctccaccgctgcacactcaaaccttctcagcttgcgactgacatggggaccccccaagtagaacagtacctcactgtgctccacaactccaagtatgcccctgatcatgagctgtaattgaaccagtattctcaggctgaagtacactgccaacttgtggaggttcactttttggttcgatgctaagcaatactccttcaatatcctcttgaagctaacactattccagacagaggtccgacccaccagcaagcagtcatctacaaaaatcaagtgtaagattgactggacctcggtagattagggtctagatctggcctctaggatgcagtatgaagtgctcatgagagggcatcagcataaaacataaagagatatggagataaaagacaaccttgccataacccaaccatggagcagaagtagtctgagggcatcccattgatcagaatggcaaaggtggaattgtagatacacatcaaaatctagtcaatctaatagggatggaatccaaactcctccagggcccgctccaggaactactaattcatgcaatcataagtctgctccatgtccagcttgatcgccatgaggtagtagcgagtggaggcacggtggaaatcgtgtataaactgctaagcaataaaaatattattggagatactatggccaccgatgaatgccccatcctactcagagcaaatctaccaaggaaggatcagcttcatcctacccaccatcagcttagcatagatattgtacaaaattgtgcacaagtagatgggtctgaagtgactcagctttgacgtatcctgtctcttcaataataggacaatgaaggttcgcttccagtctactggcatatgttgctccatgaattgattttgatgattacaatacatttgagggggttactaatgattttggcttgaaaaaagatttattgtatttcaggggcaaaattataattttatcaagttctgattcgagagtctcaaaagtaaaaacagaagatttgtgatctattggaggcaatctcatattttttggatatatattttgagagaaaatcaagtttaaaaaaaagagtcgatcctatgagtcgactcctgtcaaaaaaggctgaacggcatgctatttttagctggcacactcaaagaggatgaccctatgagtcgacctctgttgctgtgcaggccaaagatacagaacagtgactttctgttctgcgccacagaggtcgaccctatgagtagacccctgcgacagaaaatctccgtaacggctagtttttcaactcattttgatcgtatttaatgctcatttaatgcactccaacagctctatttcagtccagatttgtctctagcatcgattgaagatataaaggtacttgaaggaggaaaaaagataaggttttaaaagttctcaagcattcatttcaaccctaaggaaaaagcccttttcaagcaaaagaagctttcatttcaagttcaccaaccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttaatcgcatttcaacatgcatgtcggctaagaaaatatgggataggttagaagtaactcatgaaggcactaatcaagttaaggaatcaaaaattaacatgcttgtatacaaatatgaactctttaaaatgaagcacaatgaatcaataactgaaatatttactcactttacggatattattaatggtctaaaaagtatggataagtcttattctaacaatgatcttgtgagaaagattcttaggtctttaccaaggacttgggaggccaaagtgaccgtaatccaaaaagccaaagatctgaatatcttacccttggaggagcttctaaaatcgctaatgacacacgagctaagtatgaaacaacatcaagaagaagatgtcaagaagaagagaacaatcgccctcaaatccactgctcaactcgatgaggaatctgatgaaataaaaaataaagaacaaaataaagaaatagccctcatcactagaaagtttaaaagatttttgaagaaaaaaaaataagggatgagaaagaggccacctacaaaaggagagcataacaaggaaaaagataaagagcagctccttatttgctatgaatgtaagaagccggggcactttaggtccgaatgtccataacttaaggatcccaagaagtacaagaaaaagactatggtggctacatagagtgacagtgatgagtcaagctccgaagaagaagattcatatgagcaagccaacctgtgccttatggcacatgaaaataaggtaaacgctgaaactcctgatgactttacttttgaagaacttcaagaagcattttatgatctagttgatgatctaaagaagtttggggtaaagaacaaagaattgaaattaaagaatcaatctttactaaaagaaaataaaattatttcaaataaaaaattgatcttgacacaagaaaatttaaacttgaaaaatgaaattgctaagttaaaaccaatgatagaaaaattcactcttagttcaactaaacttcaaatgatacttgataatcaaaagattatttatgataaagtcggttttggctacaaccctttaaagaaataaaaatttttgaaaaatatctatgcgaactcatcaagcaacaaattttcaaatattacttgctttaaatgtggtaaagtaggatacatcctatacatgtttctctagcagatctgaaaatttgaatatgagaaaaatatgggttccaaaatgaaccattatgactaaccaaaaaggacccaagaaaacttggatacctaaagtgaaaacttgatttttacatgtaggtgtgtcttgcatcccaaggaacaaatcggaaatgatatcttgatagcgggtgctcaagacacgtgatcaatgatgaatctcaattcatcacacttaatgcaaaagatggagggatggtcatctttggagacaatggcaaaggaaagatcatcggtataggtaacattggtatcactcccttcaagtatattaaaaatattttattagtagatgttttaaaatataatctattaagcattagttaattctgtgataaagggtacaaagttatttttgaatcttcattatgcatagtaactagtcccaatgatgaagatattaaatttattgggcatagacatggtaatgtttatatggtagatttgaataatcttttcaagataacttgcaatgtctagtagtcttgaatgccaaaattaatgagactagttgactttggcacgtagacttatacatattagtatgtattcactttcaaaatttattaaaaaagaattggttaccagtttacctaaattgaattttgaaaaggatagaatttgtaatgcatgccaactaggtaaataaacaaaaattttattcaaatctaaaaatattgtttcaacttctaggctgttagaattattgtacataaatttatttggacccactagaacaactagttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaccgaaccactataaatcttgtttgtttgtggtgtgcatacttgctctctatctaaatttttttattttcttgctttcttgcatcccatttccatacttagcttaaatcacttactacacataacttgcttattattacttaatccttgtggttctaaattaactttaaaattttaaaaatctaattcaccccccctcttgggttgcatagctgggcaacagcatctaacccatggtgaaagacttatgcactgctcgggggcctgatcctccgccatagaccaaaccaccccttgcactttgtttgctgccactacaccagtaaggtctctgttctcctgctccaagaccacctcattgggaggtgactaaaaagcaccacttcctcttaaaggcatcatccatctcaatctaaagaagtgcactagctcctatctgatcatctcctcaatcaatcactatccatcagcactcctagtcgttggaatttgattttggtgtctccggataatggtggtctgatagaagaatctcatgtttcaaactcctttctgatccattgaactctggatttctgcctccataaaatcttgtgcggtcttaggagagagtgatgctttaagagcatgtcccaaatatcgataagatcgtgatcaataagctcaccctcccaacctcacgcttttgaacctatacaatagcagcctcaacaatctccagtttgttaaagataccatccacctcaaccctattctatcgtagtaaccactgcctcgtcaactcaagcctccagttcatctagtacctagcatcacccctcaccagtagtctctagacctccctcacgatatcccaagattaagggtaagaaagccaaaacttctcaaaccagaacggacattgggaagaggaggcatcagaagtaaataagatcggacagtggtcaaaggctattcccggcaggtgatgaaccaggtcattgagaaatctctgaatctagggggccgtcgcgagaattattaattcttttccaaaccctagcaccccctagcagttgttaaaccaaatgaacctcgaactagcaaagccaaatataagaagtttctaaattctctggactctgcatcctctacagaaagcctaccattttgtttctcatgaagacccatgatgcaattgaaatcacagccacaattgtgagagtaccctgattaatcaagcacgacacctcttaccaaatagatctcctctctctatagtcagtactaacatacacatcagataaaagccaaataataccatttatttcagaaatgataatggcaatttgctggaatcaatgatgaaagacatccatcgtagcaacactagtcctccaaataactataatatctttggccaaaccttgagacttcagagcacagaacctccaattcatcgagaagcagcggcgggcacgagccaaattcgaaccatagggtcttcttttgataagaacacataaattaggattgttcattggtgtaattttgctttcgaacttttgcattctaacagtacagatatttaatagaatgtctatatgtggtttgacaattgacgcaaaggcagcgacaaaagcaaatgccttttgtggtatctgttaaaatttctttaacaataataaatttagtcaacagataattttataatcgtgattcatatgatcctgaattaatgcaaatgtcctttaccatgcttggagatacagaacccttcaataattaatctccttctttctacaatcagaaagaataattcacatcaatttaaatatttagaagaagattgatgattatgctttgcgtgccatttttgcacgagaataatatatcaaatactcaagaatctaagaaatctcttggatctacaaatatgcaaaagcagttgtatcatttggtacattaactcagaaaatctatcgtagagatcaacaacaatacatgagatcagccgagcatctattgaatccatgctattctgagttgctaacattatcacagcactctcgttgttcaacattaagcttgtgtctggaacgaacataagaagtagtataagaggttttcaaccttcccttacaaaaaaagtgacaaaatcttcaaagtaggtgagccaattgggatttccagtggatgtgaagaaaagatagaccatggacccgtcaagaacttcatagtcagctagggcacgttgatcatccttcatcagacggccattgctgagcatcaaaatcagcctgttctcctggaaggtctccttgcttgcgatagctttcttaaggcttccgaccgttgcatcctcctcaatctccacatagaagaacctccctgttagaatctccactccgactctcatttttttctcacacagctcaagtgcatcagagagagcataaaaatgtgagtatgtagtgtccatcgcaaatttggcctccagagaacttagttgagatcctcctgatacaccacgaacggtcatgattgaagggtaaaaaccaggcgatgcatttgaacgtggaattaacaagtggcagtagaaggcaagtatgtgtcgattagattagtaaaaattgcgacatgtggaaatatatgtttctaattttaacaagtcaaatatggcaaatcactcgtggagatgcgatattttaggaaattcgtttggtagtagtcatcggcaaaatagcaaataaattccttcttgtccattttttttttcatagattaggttaatcttatcagtcaaacagcaaagatatattaggaaaatagttatgtggtcgcaattagaaaataatagatagtttctttttctaccttctacatgaaatgaatcgggtcgtattattagaaagagcgattctatttatcctgccgagatttattgccaagagaacgattgtattttgtaaaaaagaagagagagagcgaacgattctattcatctcgccgacttttatggcataattggagcctttttcttttgcctgtgccaaagttgaacgagcaaaaatattagttcagaactttgtactcaaagtgtaatcgttggccaccaaataaaagaaccatcaatattaccttcgtgaatcattccaatgctctaatttgagattaggccatggctataataaaagttgattcaccgccaatgcaccaagacctctcggccaggaaatgttccttgcatcttgtgcgagcatcggacgctagagcacttgctatgatcctacgagaaaggaaaaggcaaaaaaccactagatgtagcacacagagcaaaccagcaatactagtcccttgcatgaacagcattattccaacttaactctcccaagtcagaactcgattgaaatggcacctaaaactggcatcagcaggcaatagtgacaaggatttgtactaccttttcgctttataaatagaaggtggctgctttcccagcctccatttccacccaaaaaaaataaataaaataaaaggatttgtacgatgtatgatgcgaccgagtaggtaagactaccttagtttggttgtggagcaatcccttaccaagctttacccaccatatttgttgaagtattggccctctctccttaattctcctcaatttcaataactgttttgcttaaagatgaaccgagatcttggtgtctatgagctagagacacgaaaagaatggagaatctaaaggttccaattgatcaggatgtgaacttgcacaaatgcctcaaatgccctcacgcttcttcgccatgatcatgaagcccctagagagttgcgagatggattcccgtaggactccttgatgaaagaaatgtgatgaccaccaccaggaattgaatacccgctagtccggaaaagatgggtgttcggcattatgataaccaacgatcgcacgcttaaattttttttttaaccatggccccaattcccctctggcttcttgtatgaaaaatctattggtgactcaaaaatgaaacccagatgatcactcagacggtgggttgtattctcgctgctctctttgaatttgcattatgaaccgtgccacataatcaagcaaagcgagtaatatggcggtattacgatcagttcacttgtgagtgataatcttttcgatcaggagaataattcttctttttaccccagagaatggttcaagtaatttaattttttccaatgcatacccaaagttcttctaatgtctgaagcagcaacaaactagctagatcggacggatgagtagttataacgtagatctgcagcatcctctaacccggccatatttaaaccacagccaacagaaatttagaaagcagggttaaatactccaaaatttacgccaaataaattcttctctcttataatataggcgcaaaacagtttacaagcttcaatttagtcctggcattatttcttggcaacaccaaacagaaaatggacggagacgaaaacaaaggagacgacttgagccgaccacattaagccggccaacgacaccacacaaacgagagacgcacacgacaaaccacggacacatgacagacgcgaacggcaccaggactacaccggatcaacggctgagaattcacatcccaccacggaggcggagcaccaggtggagggtagactccttttggatattgtaatccgcgagagtcctcccgtcctccagttgcttcccggcgaagatcagcctctgctggtccggcggaatcccctccttatcctggatcttcgccttcacgttgtcaatagtgtccgagctctccacctcgagggtgatcgtcttacccgtgagagtcttcacgaagatttgcatccctcccctaaggcggagcaccaagtggagggtcgactccttctggatattatagtcggcgagggtcctgccgtcttcaagctgtttcccggcgaagatgagcctctgctggtccggggggatgccctccttgtcctggatcttcgccttgacgttgtcaatcgtgtccgaggactcgacctccagggtgatggttttgccggtgagggtcttgacgaagatctgcatcccaccgcggagacggaggacgaggtggagggtggactccttctggatattgtaatcggcgagtgtcctgccatcttcaagctgttttccggcgaagattagcctctgctggtctggggggatgccctccttgtcctggatcttggccttgacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccgggggtatgccctccttgtcctggatcttggccttaacgttgtcgatcgtgtccgaggactcgacctcgagggtgatggtcttgccggtgagggtcttgacgaagatctgcatctgttttgaggaaaagaaaaccaagaacaggcatcagaggtggttctaataacagatcgaactcactttagaaacaaagcgaaaagcggttgatcgatggttgagactataagtagatcgattgatagcgcaaggggattcaagaaggacgaacgaatcaaatcaccatccaaaaaatagcgagcgatagaaattacaacaagagataaaagatctttatctcgattgttatggagagaacaaaatcaaaaaaaatcaaaaatatttttaaaaaacaaaaagacttagaatcgctcgtaattttagcagagtagaacctatcgaaaatctaaaaagaattagggtcgctaacagtcctacaagatctggacaaagtgagcaaagaaaaattcctcaatagaaaaaaaaaaaaaaaacaacggagataagaagataggatataccttgggagattggcctaggaactcttcctttcaagaagacaaccgaaggagaatagatggaaaagaattgcagggaatgggtcctatataaagctgggattgccgactttgggcgaggaaaatgcacggacgacgtaaccaccgagaaaagcaatgccaattatcggcggacacgtatgggatatgagctgtaaagacgtgtcgtacacggaacaaggttttatttttatcattactttttttttttcccacttggttgtttggacgctccgggccgaaattagcagccacgagtgggtcaccaaaaatgactagcaaccgttggggtgcgcttggttcggatgtgccggatcacaggatatttcaataatttttaattatttatttaaaaaataattatgaaaaaaattaatttatattatatttaatttataaaaaaatatttttaaaaataatattattatgtttaataggatatatatagaaatatgatataaatttataaatatattttttaatataaaataatttttaaatattaggatagtattgtcatctctattaattttaatataatgactgtaatcatatatctctttaaataatattatttttatcttaattttttataaaaattatttattaaataaatttgaaaaaatattagaagaaatttaatgattacatatgtaattttattaaagatatttttgtcagatacgaattatcatcactcgaaagtttgtcaaatatcaatccttccatagtatttattttatcttctctcttcaaaaaataaatatgaactattaatttttttatcatctctcttttatttttcatattaaacatggtaacctgatataggattcatttttctatgtcaaattaccccgaatcaaatgcatccttaggtttgtttagttaggatatattagattatgagataatttaataatttctgagaatcatttatctaaaaaataattataaaaaaataatttttattatatttgatcagtgaaaaaattactccaaaaaatgatattgaaaaaaaattcttatatttagttggaggtaaatatatataagaatataataaaatttataaatatattttttaatataaaataaaatttaatattaagatagcattgtcatctctaattaatttttatataatgactataattatatagccctttgcataataccatctctattttaatttttttataaaaattatttattacataaatttagaaaaatattaaaataaatttcatgattatatatgtagttttattgaagatatttttgtcaataccactatcgaaaaatttatcaaatatcaacatctctataatatttattttatcttctcttttcaaaaaatatatagagaatcatcaattttttattattatttttttatatcaaatataataatctaatatatgattcattttttatcatctccaaccaaaacggacctccaaggatgtctaattatcggatgcatcagatcaaatggactggtctaatagcctctcaccttgtcattctcttgcatttagacaatttaaaattaatgagggttgcttgttacctatcatatatttgctccatgatttggattatctggttctgctctgaactaccatttaacgcaagaaaggcctctgaccggatataacatgatgaatggtgatgatgtaatgatcaatgtgatgattaaaattatctattggatatgattatttgactgctctactctgatcccgatgttcatagggggcctttgaatacaaattagaaatcctagccaactttagggttttcattccctcccttccttatctccttttcatctctttattttttttatcaaaataataaatttattcttatcaaaatatcttattatcattataattataaaataatttacataaaaaaattatatttttgatatttaaaattaaaattcatggtgatttgaaatggattttcaaatttgcactttcgatacctaatcagattatacaataatatattttatagtattttaaaaaactatatatggtaggtggatatgaggtttttaaataattcaaaattagatgagaagtgtctgttacctaccaaacattttgcttcctaatttggattggacgatcggacctggttatggtctaaactacaaactaccatttaacgcaaaagagacacgtgaagcttacggatacaaattctgggttggtccgctggatccgattggggtctaaattataatttaatgcaagagagatatatgacaaaatacaatttgatggacggtcgtgatgtaacaatctatataatgattaaaattatctactagttttggttatttgactgttcgactctgagcccgatctccacaggaagtctccaaatacaaattggaaaccctcgccaaccttaggattttttgaactctaaatctttttatggtgtaatcactgcgccataattcatatgtattttgaaattgattgataaatacatttaaatgttacatacaaataccaaacgcgaaacccgctcctagccgcccacctgattgggactcctgacaacgaaaaaaacagaagaaaaaccggcgaaaaacataagaaaattcggaaagatggaaaaaaaatttaaaaactcctttgatccgtggaaatttttttaaaaaaaaaataatttttaaaaaattaatttattaaaaattaattttttagaaataaaattttgatatatttgattgactataaaaagatgatttattataaactaacttatgtttggatgagcatatatttttttaaaaaaattatgtaaaatatctattatattctcggtagatataaaatcatacatttttacttataaattttatataaatattatattatatttatatattaatattaatattaatatattataatataacattaggctataataatttattgtgttaatataatactaatatattaatataatataaatattttaatataaatattttaatataataaatttattaatatagatataaatataatataatattaatattaatattaatattaatattatattaatgtgaatattaaaatataattaatattaatataaatattaagataatattaatataatattatattattttttagtatttcatcctaaccattcattgatattttattaaattttagctgtggatcttaaaaaagatattttacgaaagaaaaaagtatcaccacttttcatgtcatgggaagtgtcaaaatccatctcctccatgaatttctattttttaatgaaatgtgagaagtaattttccatagaaagtatttttttttactctctctgctaaaattccaatcaaacgagaggtcctttttctatttttcaaaaagtacttttttcctcctttattttttgtcaatcaattgggccctaaaggcccgttcttttgcaggtaaaaaatttacctaaaaaactgtatttttttagataagtatttttcaagcaacatttagacagaaaaataatttatctatattcttttatatattgaaaaatgatttaggaatctgctatctatgttcttttatattactatttttctggataagttgctatggtctatctatatttttcataataccttttattatataaatattattatatattatattatatttttaatataatataatatattacattatattatattaatatataaaaatatattatattattatactattataatatattatataactattatattttattattatatattataccattataatatattatcatatattataatagtacattatattgttatattattatagtataaaatattaacatattattttattttattattatgtattattattatattatatattatattatattatgttatattatataatatagcataatatattataaaatattaatatataatattattttattattatatattaatataatataatatatattatattatattatggttattataatatattatataactattatattttatgattatacactatatcattataatatattatcatatattataatagtatattatattattaaattattatttataatattatagaataaaatattaatataatatattattttatagtataaaatattatattatattatattgttatataaaataatatggtatagtatattgtaaatattaacatataatatattatattattatattgctatatattattgtattattataatatattatagtatattataatatattatactatattatagcagtattatagtattatataaatatataatattatatattttattattatatattattttattttattataacatatgatattatattatattgttatattattataagagaatgtgaaatattaatgtattatattattttattgttatacattaatataatataatataatatattattatataatattatattaatatcttattttaaaataatatgatatatattatataatattattatttatgataatatagtatagtatattataaatattaatatatatatataatatattatattattatattattatatattattataatatattatataagtattatattatattattatatgattaaagatatattaagaattaattaaatgaattatttttagttggaaaaatgatttaaccatctcctagatggataagatttttttcatttcatgagtaaatattattcatgagaaagtaacttatccattctaaaaattataaaaatttgaataaattgattaataaaaaatcgatcaatttttctataatacttatctgcaaagggacaggccccaagggtaaaatctttccccatgtagattattatttttttttgtgttttgcttctttttgttttcgcttcattctcttttttgtaggtctttggggaacgagagaatctgaggagatcataggggtttcttatgctccgattaggttttctttctcaagcagataggattttgtgcgagttgcggcggtgtgggcagcaaagggcggtgatgagcaggttgagggtggaggggtctcgcggtggtcggcgaaggcggcgaggaggcggagggtgtgggaaggccgttgtccgaggggggcgagctaggaaaagagagggaggcgacggaggatgaggaaggagaaggatcaggagggacagttggagaaggggaggagggaaactgggagagggctacgatgagagagagagagagagagagtggcggtgggagagaaaaaggaggagatggcgtgggtgaagatggaatcggagatgattgtggtgcgaaggtagagcccgagaatcattgaaatttaggggattgtttttttttggtgtggggtggggggaggatgaatcacctctggtggttttttatcccattgattaatcacctaagtagaactgtacaattgctctctgatttggattggttggcaggacttggttgagctctaaactagcactagcttagaactccgtacgatacatggtatataattatttttttaaataatatttttataaattaaaaatctaatataatataaaaaatatcatagattatatcaaatattctaaatcaaaatataaactcagacacatatatccttttgtttggttcaaagttcgcagtatatttaagtttccttatcttcaacactctatgcgagctagacaattcaaagggagctaagcatcctatacttactgatggacagtagaaggattgatgtaccattcaatttaaattttaaaaattaaagttaggaaataggtattcatagtgaactaaaccgttgattatttatcataagcatttgcaaagttcatgagaagtccataatcagctattattatgccatgataaatttatttaaaattatcaaaaaattataaaaaatataatcaaatatgtaaaaaaaatatttgagtagaaaaaaataaaaaattgaaggattaaaaactatttgatatcaaaagttttaaattctctcaacaatcctcaatcaatattaattttaacatcctgtaaattaaggatcaaaaatatatattatttttttatttttcttccaaaaaaattataaaataataaaattatattttataaaaaattaaatatagatgtcaaaaaaatgataaatattttattagatttaaaagcaagtaatttatgatcatcgtaagaaatgtcaattcttaataacttcttcctctaaaacgaaaggccgtcaaacaaattcaaaatatctcaggtcattttcattgcaccttaatgcatgtgaagctcttgtttctccaataccatatatttttcctggcattctgctcaaacaaagcatcagaactttctccccaaaaaaaaacaaagcacaggaactcaacgtctccttcgatgatgtggagggtattaatttcctgacggcaattccaatgcacttgcttcccctccctcttccctcggaaagtagactcatgtaggttatgaacggctgtgagagtgactgggagaaggagagagcgcttcaaatttggacctcaaggcaggagcgagacttgggcgttcttcgatcgacccagcaagatcgtacctccattgtcggcaccgttcagaaagactcaaaattatttataatataaacaaataattatattttttattttcataataataattgttttgataactttatgattatattataattaaataataatagcattcaagtccagttgacataaaaaattttcataaagatactaattttttttgaaaaaaatatttcctcaggattgtataatttttgaaagaaatatgataaaacaggaattctataaaaatattattcaatgtagaagaagaatgcaaaccataaataatgaccatcattttcattttatgcagccactctaggtcatcaggttgacatatgacttattcaaatattcataatttcttcacacagcatatattcgttatttttaaataaagtcccagatatcgtttaccggatatcaccggttggagtgcatttttctttacctggtatcgtcaggtcaggagataaagagcggagcgagaaagagcttggaggatggttactgtgattcgaggtgggtacatatatccgcatgcgccgtgcggaggacagcgcgtcctcgggtctcgcaatcgccgctccgttggacggataccgatcggtggcgttatcccagctttccacacggtgaatcacttcttccccccaccactcctctccctcctcttcttctcatcgtcttcttcttccgtctcattgtccccccaaaaccggcatccaaacccttctggaatagatcggaatagacccccccccctccgtacctatcaccgacctcattgcgatccaaatccaggtgatccgctttctttcttcctttctccagccgattattcctgccccaatcttgattttcttgttctacgtttccttnnnnnnnnnnnnnnnnnnnntatatatatatatatatatatatatatatatatatatatatatatatatatatatatatatatatataatagatttaatgcaagagaggcagatgaccaggtataacttgatgaacggccatgatgtggcaatcgatgtgatgattaaaattatctactttggtatggttattcgattactcaactctgagcctgttctccataggaggctttcgaatagaaattcgaaaccctcgccgtccttgctttgttaccgccaagtggaggagcgcagctcaaggtatgccctcttttttctgctgcttttcctcctcgtctgaacattttctttggataaccattcctctgtttgatggcttggcttacggtcttaaaattcggataccaggatcctcttcgtggtccatcaattgtttgacaaattctgattggttataatgaattcttcagattaatttattctagggtttcataattgacgggttatacgatttcctcggttgttttgtgcctatcgatattccccttgtgtagaagctagggttttgctgtactctgctgggatttaggacagatttaagcatagttgttggtgaagtgtttgatttggcatcatggataggttgctatattactcaagtccttttgagaggtattatatcatgcttttatttaatctgaagggttggagacttgtaattttgagttgggaacatccgtaagatggaagaacaatttatactccgggtccccccttctgtatctgaacgaatagaacgccttttcaatgagaatgcttcctcttcggaagatggttcgttggatttgtccttttcaggtatttccttgtgcctatgctttttattttcttgtttttttaatagtcctgcaacgtaatctggttcatgcctgatcggtgctgataattattaaatgtcttcagttgtgttacaaacttaatgtgtacttgtgacaatctcatttctttgtctatcgctctttacttttccatgcaaatttgtagtcttatgatgaacttttcatgaaggtatagttggagatcaaaagacccctgcgtgaatgtgatgataattcctcttttgttgactagggctggtggcagagggggttcctctaagaaaatctttcattctagtattctctttggaaaaattatgggcccaattgtgtgggttgttggagttttgcatggtcacatctaggggaaagctaatcaattctacaaaatgtaacagagacgatgaagaaaccatttaggtgatcgaatgttcttaagtagcatatgtacatgtttgagtacaataactcagaaatcctattattagaacttttcatggatcttgataacattatactccctatcccgatttaaggatatttggcctggaaccactgagtgaaattgaagattgaatgatcaattcacaatgaatgttaggtaaggttgagctcatgcattttaaaacttgttgagtgtcatgcgatatgatatataaatatgattatagtttaagcataagcattacaaatcaagatatagttgttacaattggaatagggaggtgaataggttagtcgtgggtttgggataggacatactgtagaatcttggtatgagcttcagtttagaggaggtgatagagttgctctctcaaataatgaatggtgtgggagttagcttcaggcaatttaaggtttattgctacttgagatctcttggtggttgcatgtcatgttgtcatgcatgcgcgagaacttgacgatcattttcatctaaattagttctaagttatttgccctagttaaatgtggtcagttcatcttgacttattcagaagatttgtttcttattgacaccattgtcatatattcattgagcacagcttgtgtgttttaggcattgcagtttggattccccacttcccttaaagatttgacccctttttaaattgctttccatatttttgatttcttaggctatgttgggaagcaccgtggaattgatatcagctaaaccaactattttgccaaaaaacagaatggtattctagctactctagagtacattagtccagtcaaacttgatgttaatctggttatcctagtaaacccagaataaacaacttcatcagaagaggtgaattagttcattccctgatcaaggcccatcgctcttcccaaaaacaccaataatccgtctttattctcctgacttatctttctctcaaattttttgcctgtgaatatccactttgctgacctcctgtgctaaaggtttctctgcagcatgacatccgtgcctttatcaatgggaccaccatcatcggccatgtctccaacctcagccatgacattggccaggctatcagttgattgctactagagattgatgacaacatcctcgttgattccaggccaccattctttgcaatatttggatggtagaggtttcctggactgaggttgaacccatcatccttgtcacccttgcttgaggccattggttgatccagccaagatagatgatggtgtcctcagtggcatgggggccagaaatcatggaatgtttagatggatgaggctccatgatgacagctgaatccatcatcccatcaatgccgtgtatgtgaccatcgttgttggcatcttgggaaggcaccagagtagtgcaggggaagatagtgcagatagactgtgaaactatgaattgagcatgatatgggtagagataactatgttgactacagagtggtgctagcttgctttgatagcctcataacaagccttcccaagcactgagttgtcctttttggagggaaaccctccaataccgttaaggaaggttcaacctactaatgttattaatgtaaatatccatctgattttcttctgaatgtagtgtcttgttgtttataattttaaaagaaaacttgattccttctgtggtgttctcatgcccaccaattcttttaccttatgttatttatgtttcttcttgtatgcaccaagcattttcttgtaggacgtttggttttgagttcatgtacattgttctcttgattgtttttctgtgcaacttctaaattaagtcctatttcatgcagaggatggaagaactggtacttttatgattggcaacgaaagatttcctgcctccctcttggatcttccatgcatagttgaatcttataaaacttatgatgatactgtgttaatcaaaactgctgatattggtcaggtaattgattgatgtgctctgctttgcatagttaaagatggattagaacttgacctattgaaatagaacagattattatggtaagagaagaaggtgatcctgctccagaagggattgagtacaagcatggccttaccccaccaatgagggatgctcgcagaaggcgcttccgcagagaacctgatctaaatgtacttggctgcaacttttgtctatgatatatttggtggttctcacatctttttgcatgtgcagccagagctcgtccagcgggtcgaaaaagatctacttaacattatgtctggtgggacagtagagaatatcctttttggatgataatgttttttgagatataattgctttcactgggaccttgcgtgtgcagatgaattcatgggaggttgtttggtttatgcatgcgaccttttgtcttcatttttcaatgttgttttcaccttcttattctctcacagcaataatgatgaactaataatgcatttcttttcaatttgatcctagttccgtacctggagacctttatgtcttaaagttatatgttggggttgaaatttgcctgcagttcttgccgtgtaagacacagatatataaattatatttatgatgaaatggttccttaattccttcctaggcttgcatgttgaaatggctgaacctgaggcaggtggtcaacacaagaaacctgctgagacgcctgaggcaaagccagaagacgtccccttggaggctgctactaatgggggtggtgaacgcgagaaaagtgactctgatgattcactggagcctgaaacttagagaaggaaataccaacttggttagttgaatgtgcgctactctcttaagcctcacgtagctttagtttagccctttgaagtgtatggtagagttgctaattggtttcatttcctgcagactttggctgcaacaacagaaggttgtagaaaaagtcccccggcttatccttcaaatcgtgataatggttttaccagttcttacattgtcatgggaaaaactcgtgttaaaatttttgttgcctgtcttagaactcaaaaaaccccattttggaagaaaataaaagtggtcttatgtctgtctgttacaatcttatattttctcaaaaccctttggcactagattgtgccgcttggctaaagagaagagggtgtgctatgcctgttgtcaaagtagctgcactagctcagcccctgatccgagcttaaattatgcacgcgttttctatgataaagggcaagagagagaacagattattgtgatatttgatcttttgatatgcatgttagtttattttcaaaattttttaatatttcctttaaaattatatagggtaataatggctacgcatttgggcatgatgcatgtatagccttcttgatatctcctacagtttcgttgaagagctttagcaatagttgctatggcaatggaatttctgtgacttccacatatagtgatgtgactatataagtttctggtttatttattctgatggtgctttttttaatggccgaactttatagcttgtcgatgagaacaaggatgatgattgcgttttagcccttcctttttggtcgctgtgctctcaccggcagattgatctgcggcctgctaggctgaaacccagggctggatgtgatgttctcttaaagttgtgttcttgtatcagataaccagcttgccacacggggtggtcggagatcatctaaacttccatcatcggcactgagaaaatctagcttttgcatccacgatggactagtttaatgtataggtaagttcagggagcagacccagatcggaaatagaattgaagtggatgcgaatggcatggttaattaaacaaaacactgggagaccgtacatggaagactcggccaagttcaatggtctgtggttgcttcagaaatgcaactacttaggttcaaaaaatcagaatctgcaatcggttgatcatcgcaattgatgaataacacaattaatgcagtcatactagaggatggaatgacacaattaatgcagccatactagaggaatgcgcaatccaaatcgcgactgttggagagcacttactgtctttttttttttttttttttgaatttaaaactagagcagataagctaacaacagtacttgaaccaactcaatatgcaaccaagtttgacatatatttatttgtccgggacacaagatagttgaacgctaagaatgacttgggaaggaaattaaagtaactgcctacatgcaaataaatgctcgattaatcttcttagatctaacttggcaatcttttagttcttcaaagggtgcgtatgtctatcaatctttttggcaactgtctataccatttgatgtcattatgcattcatgcatgatactcaggatttattttctatgggtggatgtatgttagtattttccaattccttcatcaaaaataacccagactgtctcgatgacactaataccgccatacatcagaccctcttccataagattaattcccataatggttcaaaataatgattgatacttgcttgttctagccttcatggaaggaaaataatggcttttacaataataactagcagttgttataatggaaaattatggataaacaataaaggaatacaagtgttgcttcctaaagtttttatttatccttttcttttcttgacattttcatggaaaaatactcagcaattcattgaaatacagttctaaagtttaacttatctacctgacccataaaatctgtcaatagaaataagtcttactacttagagcaaaattatctgtaaaatgaaaaatagttatgttgaagaagagtatgttgtggactatagtaatgatatttttttgagtgttgaataaatattgaatcattcatgaccctttcatttgtcgaattatctttagaatcgttctttgccaattgagcatgattcactaatattttgacttgaaccttccaacaagtacctagactaaaaagtaataatgtatacattatcggaagctctattttattctattgttgtagccgtgcaagtgctttttacatgaaactagtatatggtccgcatgtatgatttgttcccttttttttgcaactattcttgaaatattatataacaagataacaaattataataaatggaatactccaatagcccattttttatattaaacaataaaatttaacgataattgaacaaaaaccccatcatcaataacaatatcattaatactagcattcatatataataaattatatattacatagaacttatataatgacttgccattatactgatatcattaatagcaccagcatgatgcataggatataaattttttcttcttttttcgattagttcttgaaattcaaataacaatgtaaaacaatgtgataaataaaaggctttaatagtgacatttttgtcgtacattatgaaataaactttagtgattgccaagcacattaatattaatattgttaatatttgttacacattaagtgatgaactttgatgatggtcgaatacataatacttgtgctattaatatcgatatttataagatgaatggaagcttatcatgagctgagtctttattatacatatatatatatatatatatatatatatatatatatannnnnnnnnnnnnnnnnnnntatatatatatatatatatatatatatatatatatatatatacatacatacatacatacatacatacatacatacatacatacatacatacatacatacatatatatatatacatacatacatacacacacacagagagttatatataatagaagtttactaatgattttatcctatatatattatgactttcaatgacttgatgtttcataaacttaaaataattctttgtaattctcaaaactctgaaatccgaatcttgtcattgttatgtttttaagaaaacaatctttgtcgtagttgagttatattattgttataatgtgccaaccattttctctgcaattaagggttgaaaattgtggcccaacttatggacttgaaataaagtatcatggcaatttgattaggttaatttgttagtgttggatttggacaaaattatttgatgtcgaattcacacacatttaatatgagctatctaggttgggttgatcaaggtgttttatgtttaatttgttattttgttattagttgctaggtctctttaagatgattgaacttgcatagataatatatctttcaaatattttttaatttatttttgtttgatatgtttttcttctaatctcttgatcttgtgaagttaagatttaatttcttatcattgtattaaaaaaattgaattatattttttatgtgaaaaaatatattttttttttcgcgatatcaactgttggatggcacaatggcctctttaaaatttttgcggatagatcgaagaaaaaaaagaattgctttgacagctgtgtaatacgcattcaaatgtttgatactataaaaaaattaattattttttttgtacgaaggatgcaacctaattctcatattaaattatcaccttcttgagtagattttgttgaaatatggtgttaccttcccttcttatttatggatatttaacactgcactaattagaactgatgggacaagatgggtttggcttagttgatgcataggcatggtatggttgagttggtattggtctattctctcgcaagaagaaggctccaagttaggtgaactgggttcgattccaggtcacaacttctacaggagatattaaacctttttttttcttaccacataaaagtaaaatctatagcaatcttcagacgaggagtagtaaaatccaaccagaatcaactaaccggctcattgccaccagttttggctgttgtgcgttgtgcaccaaccagctaatccgaatcccgataagaagactaccgtaatgggtgcggaaactgcgtcgctccaacgccaagcccgctggtccccacgaattcgattcgcacgcgtgatgtgagcccccaaatcccgatgggaaactgacacgccccaccgcgctcgacaccccaaaccgaccttgtctcgcgaattccagagcacccaccgagcaatctcagccgtccgcaccctcccaccaccgccagcggacgccaactaactgacagcatctagaagatcgttccagaagagaataaccccacggatataccaagtcgtccgtacttattagtatgcggttagctttacgattagctaggttctaattgtagagaacgttggccttagattagttgtttcgtatagcactcttatgcgggcggttggatggggtatgtgagtttagcataaggatgaaagggtctgtggtcagaaagaaagagtaaaagaaaaccccaggagttaagaatttttttaatctccgtctataaataggaaactaagtctcggcgaaggagttcataaagaggaccgagagcggatctcccgtgcgagcgatttagggatctcaacgacgcgagtccaaatcctcgtctccggcgaggtaggaaagattcttgttcggtgaactagtatttctttcgtgctttttttttttgaattattctattggtgttcgtatgatcttaggattttcttatttcctcttgtgatttggagttgataaggggtttttgatttttttcgttttccttggtaaattctttattttttagttctgttcctgtttgcggtatctgagatctggttctttgcgtggattactagtagagagttcttgaaagtcggggcttctttatgatattactggtttatgttgagggtattcaagatctccttttgctcctcgtttttgttccctgatacgcatccttgcaagcctttcttgaaaagaaagttttatccttggtttatgtcgagaaattggtacatattggctctttttccttcaatttttctttcattgttggcatgttatttattgtatgtcatcgcgtgatatatttgtgttctaaatgtagacgctagataatatctttattagaaaagggttacaagtccagaggggcgtatgtgaaggccatatttgttttccatgaaaattaggattttaatttaacaaagtatccgatcctgacttgatatccattttgatgctcgtttttttttcataatcttgaaatatgtggggggctttgttcctccctttttttttgtgggcggggtgttctgggtaggagaaatcctatccttattatgattttgttttgtttgttcacttgtttgcgattagaagcttgttatatatggaataaccgatgtatgtaggttatttttggtcccaaccttttattctagattgtatctgtccatacctgccgttctttcagatactgatgagtgcaaaaggaagatttttactgcaatgatgctagattttatataccaagatttgaaagcttattgagtcctgttgtgtgatctgtgttggtcaatggttgtcaagacattttggcttggtctaatatctataataattaatgatgttaagctgaccaagtggattcaaatttggccagaattttgatgggtattttctcgaaaagagtcaggttgggacatggtttaacatgttgataatgttttgggggtcacaagttaatttagatttatactgttcattgagtctagatgtaaagagttaagaccatttaaaaaattaatttagtggtgtgttgcctggtcaatcttggtcagttgggtgaaaatgtggcaaggtccaagtttggcctcacacaaatgcaaagagcttaaatcatctggtgaggagagaagtttgcttgtcttttggcaatgctgatgcaaccttactgctgaatgaatttgggcattggatttcacatattcctgattaggctaataaaataatctagtggaatatacagttctttaacgtgagaaaatttcatgcatttgtttgacgcttttgagtgatcaagttcagaggttatttggcaattttcatggattcatgctgttgactctggatatgtaatcttctcttctcggttttaatcatccgcttggtatttgtgtgccattccacagcatatgttgagaccatacacagtgtaagatcatatggataacatttcataatttgaatgataatataactgagggaatatacatatcaatttacttatatttatgtatgtataatgcatgtatatatctgtcattcttctgttaatttatacgatgggttaatattattgaaatggcactctgcttaaatgcataaagtcttttcattgaagaggctggagttaaatgcctcttaagcttttaaataaaattgcagatattatgacaaaaatcttgggacataattttaattaggtatgcatttttttttttgtaatttcatagtcatgatagctttgttgagaaaacaccattgctgattttatacttcattagccttcaatgagatttgtttgttagcttttggtggagtagctgaagagatgatatgttcgtttgctggttgttatgaattttcattccgcccaccccccccctccccggcttcttcttaattgtcctctgaaatctaacaaaattcatgtctcgtggttttcagcttgagcataactttcaaaaaagcaggtagatatttgttcgtttgatctctgtcgattttcaacagtcaagtgttcatgtctgatcttgacgttcagattccaactgcttttggtatgtttgcgaaatcctgttcttgacttcttgactgtttgcttgcattcacattctctttgtagcaaatcatttatatgaaagcatgatttatactcctttctgaatctttagtgccccgatttcttttggatgcagatccgtttgccgaggcaaatgctgatgactctggtgctggtgcaaaagagtatgtgcatgtgcgcatacagcagcgcaacggcaggaagagtctgaccaccgtgcaaggattgaaaaaggaattcagctataacaagatcttaaaggatctcaagaaggagttctgctgcaatggtactgttgtccaggacccagagctgggccaggtacggcggtatcacatgtatttagatgctgacaatgcaagaaatctggatatatttctagtgcgcttgttattacttctgtttcatccttaaatgcattgtgatttgcaggtcattcaacttcaaggtgatcaacggaagaatgtggccactttccttgttcaggtattctttttgccatgtttgtttgatgggaggtgatttcctagggtgatttctctaggctctgtatgttcacttatggaaactttcagcctcattaatatggctgacgcttggggtggggcagagttgtctttttctttttttctcctgaattctgggtggacaatcaggttgataaggatgaccatagcgaacggaattatgtttttatagaacggtacctaattccccaacacaaaaagggccctcttgttagttatatctttagaaaaaaataaaaaagaataagaccaaaagaactcttgaattcacacttgttagtcatatatcttgggggtagaaaaaaaaaagacacgagaccaaaacgaagggagttacgagtggtcatcagagagggagggtggagtaaatgtgatgaacaaaatgcagtaaatctccaagtttgcaagtgatcagggacagaagtcttagaatttatcaaagtcccctttacctgttagtgcaggaggcctctggaatctgttatgcttggttcaggtggttagagggtattgaccaactttgatctttcgaccatcccaggggtctagaaaggttttaaaaatttatcaaccgatggaacctcagtgcaggtggccagaccaaaatgttgaagttgttatacctggttcaagcgattagagaatattgagcggtgtcttgattagccttgtggcctactggatccggctaccaggggactggaaataggttttaagaatttatcaagctgtttggaaacctgtttgtgcagaaatcgtgtcccttttttaatcagatctaacccatccgtcctccccgacccctttatatcagacagatggtctcgtttcatattacctcccctacattgactactcttctcgacgagtccatgcacggtggttccgttttgtatggctgcgatggggagctcatgggggtagttctaagctttgcttatccctgctaatgacacttaatcttgtgttgcaggccggcatcgtgaagaaagagcacattaaaatacatggtttctgagcagctgcaaatcaagcagcagtagtgttaccagacagcagttggacatatattatcttgttagctatttctctcttcatgcttgatataatctgtcctgtgagactatgggagcacttctccagttgccttgtttcagtgacctgacttggattaaggacgtatgctacgttgtgttttttgttgttagctacagtttgaagttaacttgtttgggtttgaataacagatcttatagtttgggtaccgtgtattttacgctacgtgcttctagctctcgagcatttcaaatttcatgtttagtcgttgagaaaaccagcggttggctagttggcattgttaggacgtatacctcattcgaggaaggggaggccctccgaatttggtggaaggcatgcttcagcacctcccgccaggctctctgttgaaaagaagttcaaggacaaagtagggccgggagcgtgcagaccaaaagacggtctcaaaagtgtcacagatcataaatacaatttaaatctaagatgaataaaactatctgtaagtcgcgatgtgcccatttgaaccaaccgctggagccttgagaaggatgacgatggggatgccaacggcccaaagccaatagaagatagaactggaaccggttaggatggaagacagcgttgtggtggaatggataagttctctagtgcagcaagtttcactgcttttccccagggaaacttgctgcactagagaacttggtgaagtaataagagaagcatcccacaaagaccatggtaacgatatagaaaaccataagcccctgatctgtgagtaaatgtcataggaggaatgtgaagaagaaacatcagcaaccaccatatgtgagaagaagcaaaagcattggttcaccaaagagatacaaaaagcgccactgatccatcacatccttgaaatggtaagtgaagtcgcaacattcttctgttgcaaacttgtttcatatttcgagcaagggttctgtctttttgtgtaaagtgagcctgtgaaggcacttaataagtcgatacacagcgccatatcctcaaacataaataaggtaacttgaaaacatttctaaccaatagaatccgtcctgcaaatataacagagtacaaatgtggaacttgcaatgataaggtaagaacctgccaaggagcgtcccacgagacgtgaactatatgggattctgaagacaataaagagtgccgccacagaagaacaacatgctgaataagtataatcggtagccggagaacctgagacagatctcagcatcataatacagcatgataacctgctgctcctgccagtctagaggactttccattatagagcctaaaataagagcgcttgaccactaaagttcaatccggattgtacatcctctggctcagttagaggtcaaaggattggttataggtggcaaaatctctgttttgaggttcagcggaccagtctgatagtcactcgccaccttgccctcttctatttaaacaattctagatctaatgtagggtgcttgttatccactgtgtacatatactatgggatttgggatttaggttggtccactgaacctggtccatgtaataatttcttctgtttcaatcctttctaacttgagagagagagagagagagagagagagagagagagnnnnnnnnnnnnnnnnnnnnnnnnnnnnnnnnnnnnnnnnnnnnnnnnnnnnnnnnnnnnnnnnnnnnnnnnnnnnnnnnnnagagagagagagagaggtccaagcacttgctgttctcggttgaattccaaatactggaaggtggtaaagtaatttagtgcaaacctaaaagttctatatgtactaaacaaaatttgtatgttagtgctgattgaaaagaggatttttcaatattttagcatattttatgaacttacttttaataaattttatcatattttgtcgagaaaaaattattttcaaaaatagcaacagaacaattattatatttggttagaggtaatattatgcggaagcattgccaacttttgaacatatttttgaataaataattcaactaataattttttgatttcgtctatttgttaactattcattacctatttatatgaatgttgccaatatagtccaaataaatctatatgagttaataaatatttttaaatatttattatacatacattaaaaaaattttaaatatttgttatacatacactaggaagtatatttttttttataaataaatttttagtattttcaatgatagagattcatcgaaaatggtgctggtgttatattttgagttgcaaccatgtgggatccacaatattcaaaggaagcattttatgggtttcaacgaaatacgtgagggcctgtaattcatgggtctttcgttagtttttagagaggattatcaggtgattaagaacccttgatgtacaccagcaaaacattttgagcgatgaaagcttttttaatttaattactatttaaaggatcactaaacttttttttttcctctcaaaaaaaaaaagaaagaaagagaagctaaattgcaactcgaaatttaacgaccatgtctgtttattttctcgtaattcttgccacacctgcatggttgggggtttctgataatgaaaactaaattggtttctgataataaaaattaaatacagaaaacaaatgaataaatgatataacatcattctcttaaataatgtgatcatatcatctgcaccatgcccaggaaacaaaaccattctctcttgatgtgatggagagcttgtcacagattgcactcttctggcagcacgggatacctttcatagtctttgcagtagtcatatatgacgaggttccttccaacccagctaaaatcctcaagctggctatcagggaggctccacgcctcatactggtcccaccaattctcggtggtggtggagacgcaggctgggaagggatccttccactggcaaccatcagcatggaagtctttgtaggaggagacgaagggcgcattcttccaatctgtcttctcgaggcctccccttgtcgcccagtcatcagcattccagatgcttgagaacatatacattggcttctcatttggaaaaaagttatttggcttatcagtgttcttgtgaactctaatgggaactctgtccacaaaaaacctgcagtagagtagcgtggagatattagaagttcgtaggtatgttaatttgcactgctgatggaaaaccaggaactagtcaagttcatttgtgttggtttgagactttggtactgaggcctatgacttggtttgtctgatgaagttggtctcgacttcaaacaggaaaatttctgatttcggatttaggcctttgtttatcaaagaacttattaggttaatttggcagatctaatctgattaagttggatgcaaattttttatattctacacccattttttagtaaagttggtcctagtatttaaatcttgtacttggggtccagttggacctgtttgtagttattgcttattccaatcagagtgaagccccaccccatacgcccacttgattggagttgacttactgcagccaccgtacttaagaccctgctgaagaaccataatttactaacaggatctacctcatcctgaattaccttaggcatgcctggatttctagtggttctaaaggggagagttaaaggagaatgtttgaagggaatactcacacgatatggtggttattccaaaggatggaataggtgtggaagtcttcggtgggatcaaaccacagcatgtgcctcatctctctcccaccaagcccactcttgtacacattggtctgtatggtgtatggctgcccggtcctgttacccaagaactcaaaatccagctcatctctgtctggccctgctcccaagtccgaacacatctgcaatcatcaaacacagagatctaaatccaatccaaatccttcaaagatactgtcgtctaaatctcatctaatatgccacatacataataagccgtaacaactcccgccgagtccccgccgacgaacttcagcttcatgctgaaccacccaaatctgtatctctgtcgtgtttggaagccgcaacctgcagtgcatttgtgtttttgtcattagaattcaaaaatagagagagaagggagacttcaaatcatactttcactaaatgtggatctcagaagaacgtgatcgataaatgcacaaaagatcggttgcagtttgagatcttagatgtcttgtattgcaaagagaaagatcatatgtttcctattctaatcttcaatttcttaatgatggatttagagaaggaatataggaacgtgatcaaccaaacaacattaacataacgcaagaatgttactaaaactataagaaggctgtcacctgttttcttgtccaaatagaggtaccacacttgcccatcaggcgatgtcttgaaatggtcttccgcccacatgatgttgaagttatccttgaaggaagaaaaggtcgatgggttcgccggagctgccgaagaaggactcatggagcttgcaatgcatagaagaagcatccatgaagaaagccatagccccatatttgctccttggaagaaggggaagaaggagaggtggaaggctagccctcagacttccagctggagcctgagagcgtacaacacactgaagcttatagcagctttgattcctcacatatcatgcgtgactcacaattatataatgctagctatcacactagatcagatcctttaaaaaaaaaaaattgaaaagaagttaggtgtgcatccatcacaccaagccatgtcgtggtagttaggtcaaagagctcaataggaatctgacaactggccatggacatgcaatgaaactggcagcttttaatactgcccttagctataattgagctgtggcccctgggtattgagatgagaaatacatggtggttcagtgtggaagactcacagtgaagtgctccctttcaatgtcaagaatacagagacggaatgtgaaatccaggctgcctcgggctggccttcgagattgggtcaaatacagacagttgcaagtgggggcagcatgttgcgtataatatttggaatgggaggagatagagaaagacatgaatgattggccgttaaataatgggaaggttcctatgagcctcacaaaagtatggccttgggtcacgggaagtatctgttagtggctgtcccttgagctatttttgagcgtgaaagttgaatttgaattgggtaaagcaaaggttaggaactaattcttttgggtttaaacttagagcatctgaaatgctcccatatgatgtgatgttgtgaattgttctgttttggtctattttgttgttctcaaatcgccagtacatggcccgtttccttgtaggtgctctgccgacactgggaaagaagacatacagatctgctttcaggttaaaatatagcgtaaggcttcttctctttcccatgttgagcacgatgaggaaagcttgtttcactctgcaacttgagttctatttttagtcagctgttaatttggtggaaatattattatccttagcaggattcaatgccaggaatcttggccaatgcaagtgacagtgatctcaattgcaatcttgatggtcttgagcggccaatcctcccgtcgtccgatcgccggggtcgcacacctgcaaggaaaatcctcaccgatcggagatgtctccggcggagattctccgacggtcaagtcagaggaagactaggcaacagtggaaaatcaggagctcaacggggggagagagagagctcaagagcttaaagacgcttcagaggatttgagaaagcttatcgaaactattgccttaccccgttttatagtagaatgcaatatggtcccgctattaatggtgcagacaactggggagttgtcaaatcgtcggagactgtcaaatcgccgtgggttgtcaagtcattgaaattaatcctctttggcaggacaatgccccagagcgaccgtaccgcgtgttcttggcaggacaacagcccatagcggttgtacggtgttcagatgggccggcagactatatgtcggtattcagctgtcggaacgtcgggtgatgactcgagaacactgtcggctgatctgatgccttgtggaagtcggacatcggctgccacccccgacagtgagtcagtgatatgggttcgaccgctcgactggtcgagaacagtatggatctgttcgatcggcataccttcggtcggatattgtcggcagtcattgtcggcagttattgtcagagttgttgtcggagtcgtccgtcggatcgatcggtagagtcggacgtcgatcggatcagtctgaagataagtcggcgtacagggaccagtcggtatatcttaacacctagtaaaagattaaatgctttcttaattcagtaaaatcttcagtggcatagagtgcaaacagaatccattacaaatgagatggatagactgaaattttagtttttttttatttttagcaaagatttttagccaataaataaacaacgtggtgcattgtaaacagaattcttttttgcccaacttggtacttggggttatcgggaaagtttgacaaaatttctgaaagacgtctgtgagaaagctccaaggagctctttaagtgatgtaggtagatccggttctacaatcagtaagggcggtccagctttttggcaatcaaaaggagtcccgaaccggaattgaattcatggcctgaaaaaaaaaaaaatggttgtaaatctcttgcacaataattctggcaccttgagcaagatccataacaaagcttctaagcattaacgtaaaggtggacagcacactttttctcgtcattacaatcttcccaatagtaatgtataatgctcactctcttatgaactctaacctctgtaccccacccaaatccaatcgagactgtaaacttttacctggggtacgggtccaaagataaaccagtaaaaggcttgtaatcgaggtctgggtttaggaaaaacatacccaacctgacccaaatccaacaatctattcaacaagtatcatgcataaatgaatttacatatatatatatatatatatatatatatatatatatattatatatatatatatatatatatatatatatatatatatatatatatatatatatatatatatatatatatannnnnnnnnnnnnnnnnnnntttttttggaaatataccgatatagtaagtttcccttgtcccatcattcctcgctttcttgtgtcacctccgtcaaaggctccttcacatcatcccatctctgactattattcattttcaaattatttttcttgtattgccttctttttttttttggttgcaatgtattgcctttagtttttcaattatggatccattgagctagacctgatccatgcttcattcacattgttcatagatataacaggtgttatgcatcaaatccaaatccatctcaatcaattgatgcttagaatctgaataaaagtttaaacgatctctttaggttacatttagttcaggcataaaaataggcataaggcttgaaataatcctgtggctttcaaatagcattagagatgaagacctaaataggaaatagttatcccgctcgtactttcttgggataggtagagcttccccaatgagagttgcataagctattttttgcgcataaggacccatttcatacctgctttttattttttaatgaacaaaaggcgtcattcaagaattatttaaaaaaaaaaacatcaatatttttgctattctttgtattaaaaaatagaataaaaaaaaaagatgtaattcagcataattattttcataaatatagcttttgtgattcttagttttcttcttcccgaaccaaatgcaacattaatatttaggcttaggttggattacacttggaccataaaatctagtttcgataaagaaaggaagctctagtctggccaaggattagtctatatttttttaatatacattatatatcatgcacacctcaacgtgtgaatgatggttttgatgttacggctataaccaagcatgtacaacgcacattttagggaaaagagagggagaagcaagtgaccggttgaattttgtttaatcaaattagagagaatgaaagaatccaatctttttgagagtttacagaagggttataatttgattatgaaaggtggagagaaagcacatatggtacttaccgttagttaaaaagttattgggttaaaaataggtttttgaagataaatacgaggatgttcttggtagatggatggaagtattcaaacttatcagttttatatgtaataccaataaggccataagggagggatgagtgctctatccccaaatttatcccatctataatgttaaaatgaccaaaaatatcatttattagccaaaaaaatagatggctatagctatctttaatccacaaataaccaacatgattcaatgatattatagtataaaataatcaaaaaatagggataaaaatgatttatccattttaaaaaagacttgtcctgccttattcgatcataaaattaattatggagtgtaataacttatctttggatcgctcattctgatccaaatccaggccttacaattaaaatgaaagcacttcaaaattttattaaaaatttgcgtgcttggaaatatctatattaatgttgtcaaagatttcacttgaacattgacatttatggactgttttaggtttagccatgcaaaacaaaacaattgatatgactgaccttttccaatagaatggaatgcagttgacaaaattagtcaaatctaatatgcatcatctttgttaatctacaaaacaaatgggtagagcatttatcagggttggcttcgatcggatccttcaatacttaagtcagaaaagatttctcatgatagaggaaaagaataaagagcaaaataggagaaaagagaggcttgtgagtatgtatattgcagcacttttcatggaagggtttggggttatatgcagccatcggattcgaaatatcctgatgatcatggaacaactatctgaaattatactgtaacggtacaataactattcatggacatgatgtaatcatctaagattataccctaatcaccttaggatgtaatgtaactatctaaagaagtagagtaatcatccatagtcattattataggctttaactctcgacgtagtggaagaagcctatttctacactaagtaatagagccattgagctaaatatttgtttgagttgtgaaactttatttgatacattgggtgacatgtgatctcagagagctcgattgtttctatcatactcagcttgggttttagattgatcaaagttgacatgatccgattgcatcaagtagttacagagtttatctcagttactacatcagccgtgagttagatgaatttggtcatgctatcattagacttattttcggccacattacttcctaaggttacaaaaaattcttgcaggaaggtactcctaggttaatgcggagactaaatttgatataacattgcaacgaaggacaagcctgattaaaggacaatggtggccaaggctaagaaacctagtgcgtgactggcttaaagcaccaggccagggccagcatggggaaaaccccgcccgggtatgtgaggtttgaaagtagcgttctccgtcagccttggcatggcagaataaggaggccagcctgaaattatttggattttgattcctagggcaacaaataaatgtctggcttagcaagtaatcaagcttgcgcaaagcccagaaaataccaataatctgtaatccgatagtcttatcaactaaatctgagcacacgtgcacagacacacaaaacaactatggaaaaggaatcaacgaggtgctttgcatccaaacatcgagttgcttttgccatctctttcactttgcagacgatgaatcctagtctcgcaccaaccatacgagtggatggctgctagagatcgtgggaagaagaattatcgttgttttgggggttatcgatgatgggatggccaagtgtagtaggatatagtgggtggatggatggcttttctatcgttaggtttaataatgacatcaattcctcaagatcgtaccttcggggttccatgctcatctatatatatgaacttaaaaaactaaattttatctgctccatctctcatgttcaactgattctgttgggagcccattgcttgtcgtagcaattagctggggtgggtaggatagtggcagcgagtggggatcgatttctacttttcttttcccttattttctccctccctgtgtcaaaataagagacgttaaataccttttttccaaccggcctgtccgagagtcttggcttgggttgggacgggagggggcagcatgcgagaattaggcctcgctagccttggtagtaactgtttattaatccttttttccctgtgtacaaataagtgaagggcaaacagaaaaaaaagagcaaggaaacatctactgttcctactaattcctatgaaagattcgatatgaactgatttaactattatgcatatttaaaaagattatcatacttaacatagattatgtttatcattattcgatgtagttcatattggccactatgaacaaagctaaataggatctaagatcaagatccatcgtatcaagaagttgaatcatatgccaaattttaggaggcataacttcattaaatgatgtccgattgagatgtttttttttaaattagatatctttttaagatttataactttagactagtccttaaaaggctaaattggaccaaaatgtcataatttgagttttgaaatggattagtcaaactaatttttttcttttcaaaaaagattttgatcgaaaattatctttcaatctataaagaattagatggagtgatagaagataattaatgtaaaaattgaaatctatctcttataaaattttagtatttttaaataatttttatattcatcataattttttagagatctctatttaaggtagaaagatggattcaatccaaattgctcaaggatggaagttcttgtaaaaagtaaaaaaaagtaattaaatttgaaatatgtaaggatggatcacactattataaatagggactatgtacctcagtttgtagtatagaaaattaattaataaaaaaatagagacttaaattctactttcataatttttttattatcttttctttttttgttagattcgaggttagtgggtcgcagaaaatctttattctttccgattggatcactcatggcatcaattacttcagggttccatgctcctttatatatatgaaatttaaaaattattttttttttctgcttgatctccgatgttcaaccaactctcttcggggtcgaatgctctgaactgggattttaatcctggtttcaccctggttattccaatgttgtccctgggagaatggtaagtttggtttgagtctaaaatgtatgcaggagatcctccatcagtcacgagtgggagaagtaacccaaggacatggagtagaagactctataccattagaacggatgcatgctattgtcttgttgttataggttggcaggttttaatgtaaagcatgattagcgcgtctgtgaatagagctggttggtaaaagaacgggaaaacggagagaactgaggcatctattttttttaaaaaaagagagacgtccttttttaagttcttgtgaaacatcccggttcgttccttttttttgtgagccttttggacggtatcctttttaaaagacttcgctgtttacgataaagagagggagagaggcgacattttttggacaagagccccctgtggcgtactggcgttcctttggtagtgttctaatttgaattattcacctgtagcgctcttctaaaaaagacgagcaaagctccttctcggctttcagatatttttcaaaaggttttttactttttccaactccattcttctcgtatatctatcaaattgtggtgtttattcttggcgacctggactaactgatcttatttcacaagagatggtgctagttgttgtatatgctatataataatgcatagattttccaaaacatcaagattttaaattggctctccattttatatgctttcaaggcccaggcaaattcggttaaacatccaaacttccagacgagcaacaccatgtctaccagcattatgggtggtagttgatattgtagcatgtgatatatctagccgaaagagtgccccagggataagtctgatcatacatgatattgttattgatattattttgtttataaattttttttaataaaaatatattttaacatagatgttctttttaaagatgcgttatatggaccatcatggtccaattttatatggctgatttgacaacttgcaattgttgaaccttaacttggatggtactgtctcttgcccgttaagcgagcggtcagggatcatttgggacggtctcaaccttcctttataggaaaaaaaaaaaaaaccctctttttatcatatttttttaatattaattttaaagatgaaaactaaaaatcaaagacagtcattagttttataattaaaaataaaaaatatgatattctttttttttaaatataatttttatcaatacatactatatagtcgattaatacacaccaaacaaactaattattaaattaatacatagctctacgtaaaatgatacataattttcgagatatagatttcactaataaataatatatggttaggtaatatatatttaataaattagtcatttaataacgcaatgtatatctccaaatgaattgatacatcattttagaacattatgttcaccaatacatacaatatagcctagtgatatatattcatcgacttcctaatatataatacaaacttttttgatatacatctagcgatgatccatacatacttttagattaatatataatttttaaaatatattttttatccataagtatttattggattattgctgggtgtgtattaatgaagcttataatatatatcaaaaaattaaggaatatgtatcatccaatcatgtagtgcatattgatgaatttgatattccataaattatgtatcaatttttaaaagatgcgtattagattgctagatgactaatgctaaatatatatcacttgattatgtattgatgaactctatattttaaaaattatatcaatttatttagagatatatgttaacttacttaataattaatttacttggcatgtatgatttggccgtgtactatatgttggtcattattatgttctaatagttatagagagtctttctgtaaatagtattctatcgaaataatgatcattttatataaaagattttgataaacttcagaattatctaaactatatgattaggataagagtaagaaatttgacttatcgagagtctagttggattagctcattaatttataatgcaaaaatagaaatgaagtctaagtatgtgattactattttaagataaatttttaatcttatgctggtgtttattagaaattttatctcaagatatgatcgggatactctctcttagagcgtgatcatgaagagaattgacagatatcttaaaactcaacaatttaaacagaagtgaaaaagtgtttaaatactaaaaagataaagtaggagagagagagataagagttgagaaaaaaaaatatactacttgtagtgcctgattccatccgaactcatagtcttatataaactataagatgacacaatgagacactttaactaattgatcatgatgggaagagatcgatcaaagaaagatatgttcatctgaaaaatacgatcatttggtcaaacagtaaattgaccattgcgttagcgaaaatttaaaaaatatgatgataaaataataaaaataaaaataaaatagtcataccatcacctatgcatgccacaccacatcgcatttttgcacacatgcgaaacgagtcggaccggatggtgcacgtatgtgtgatgtaaaattcatttttttcgttggctaaagcaaaaatgagcaagaaaaaaaggtatataagcatcaaaagaaaattgctcttttctaatgggactaaattcaaggcaaaagattttaggaacctttgacgaaagaaaaattttgagttttctctctaaaactctaatactagaaactgtatatccgtttatccatagatgtacatttacttgttagatgtttaatttatttaatgtgtattatttgattatgtaggatctactaacaaaaagcatgttttcaatataacgaggaaagaggtcaagaggatgctatacttttgttaattatgagactaatgacttagttggtaaaagaaatatttaatttttacccctttttttttttttaatgggtactaagagaaacatgaaaatcagaatcacattccattttttttttatagtgcctgtccatatgatttttgtcacccctcccacccttttttatagtgcctgcccatatgatttttgtcacctctcccaccccctacactcttattcttatgttataataggagaagtaaaatacttttccccagctagtctgtccgggagtctccgcttgggttgagttgggagaggatagcttgtgagaattagcccttgcttgtcctaatagtagtactctatttttctatttttccttcttgaataaaaggtttttttttttgaaaaaaggcgaccaaacacctgctcctgcaaattgtgcttgtacgcaagagattcggctttcaaggagatggttaaatcgtggcccaagcgatcagtatgagcgagggtcgatgacccaaacccgagctcccgttcatagcccataccccttagcattttctcaccctctctttctatccaaggagaaacatagccccctcttcaaaatctaaaatataaattattttttttctattcaataaaaatattaatattatcaatcggatacgatcagaatttgacatatttatcggaagataaatactgttacagattgaatgacgatatttattacaaagcattcgaataattgagtccggagataaagtgggatctgctcatcggtactgcaaaattttgtatatcttgattttttagattactcttgtatcatattagtatctgctttcatttgtatcaaaaaaaaatattattattagaaatagaatgaagatatttttggtgatatgaaagataaaaataaataaataaataaagagagtggcaccggcctctattaaaaatgtaaaagtatttacaaaaaatcatagatactgctggatagagcgcgctccgatgaacggatgtattgctgacatcgataccgctggatgatggataagagggcacacggcggcagcgaaagtttttcgcccgttcttccatggatttgagcatcagcatgagttttttttggtctttatgcgtgccgcccgtgctatggcacccaaaaaggtcacaaaatgtcgagatcaaggtgcattaaaaaaaaaatggagaagatattggggataggttatattcactccctgatgcgtttaacaagcaatcagaaaattttgctgttgccagcaccggacgcccccatccatagcggtgaccatagacatccataacaagagaaattatatcctaaattagaggtccaatcaagtcaagataaatttaatagttaaaaattcgagttcaactcaactcaaaatattcaaatttaaaatttaattgaagattaattaaatcttaatatatcaaattcgaactcaatttgataaaaaatagtcaaaatttgagaatgattcaacttagcttgaataccaaccgagccatattcgagatcaagctttcgttcgaaattgaatcttagcttgaaatcaaaccataatctatcagtaatataatattataaataaaaataatatatatatatatatatatttatttattcaagtaggttcatgagcttttgagtcgaatatcttgctacttaagctcgataataatcgagtcaaatagagctcaagtaacttatgaataatttgactcgtttgtatccctactctatacgcaataccccacatattgtccagtcagagcagtctcactcatataataaagcattgagataaatatttgattaataagagttatgataatgagcggttatgattaattatgtacatgatgatcttatatatgaagtgtagaatataattttttatgactataaattttaaaaaattatgttatactgtatgcattgcatggttatacaaatcatcaactatagttgtattctttaaggttttattcatcaaattagcatcttgatgtaccgctgtaaaaaggagcagctgtgattgatggtctacatgtgaccgtgggtacaatttctcgtgaatttcccaaaccccgatcgtcgatattggcccatggctaaaccgcttggtcgttcccaacgttcacgcggggaaccacgtcgccgcctgtgtggcctgccgcgccgtgcgctcgtgtgagaaatcttttggaaaccgatgccgctcgttgcttgcacggagctctttttttaaataatataaaaaaaattaatttataaaaataatttaaaatttaatttttttttatcaaagtaatgcaaaagaagaaaatgtcattttgaatgacgttttttccttccacatcatctctattttttttcacgatggcatcgttcgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcaaattttacttcaaattaaaaatttaattttttttatttaaatttataattatataacttttttattttttcatttctttctgtttttgtgaaatttttttaggctatttttttatttatttcgaatattttttaaataaattaattttaatttgagaaagtaatttgaaatgatatttttattttaattaattttaaaaaaattatttcttttaaatttcatattataattcttatttttctcaattttttttaaaattttgattttttaatggcactttttattttttaaagtttttttcgatttgttattaaaaaacaataattcgaaaaaaaatcatcttaaattaattttttatttgaattacaaatttaaatttttatattttaaatttcaatcaaaatcaaaattttaatttatttattaatttaaaattttaaaaattattttttcccatactttcttgatttttttttttggataaaaaaaatgaaaaatgccaatttgaatggtgtttttagaaacgtcattttaaatggcgtttttaaaaacgctattcaaacccgcatttctaaaaacgtcactttcaccatcattttttttttttcggacgatgccatcgtggaaaaaaataggggtgacgtggaaggagaaaatactattcaaaatggtgtttcctccttttgcattactttgataaaaaaattaaattttaaattatttttgtaaataattttttttttatattatttaggaaaagagctctgcttgcacgcccgtcgtgaatgagcagatagaaccatcgggaaccaaaaaaagaaaattttatttgagttttgaacctcgaaagtgaaagcaaaaccggtatttattggtatgagatttattactaaactaaataatatttcaaattctaaaaatatagacccatttccaaccacttccataactaatgcatcaatccatttaagtttctgctcatcaatcatatatatatatatatatatatannnnnnnnnnnnnnnnnnnnatataatatattattattattattattattatatatatatatatatatatatattatatatatatatatatatatatatatatatatatatatatatatatatattttgttattccatgcgtcgcatgggttttaatacgtggtgtcgtattataataaacaccttagatttgtcttattcatcacttctataacccctttttgccgaaagtctgattttttcgtggttattaattaatgcttgcgtggccatggctatgagtaattttaatatcaaagattatctgctgattcgactacataaattcatttctacgggtgtgatggaattgcagagctgaaaaataaaaaccagtgtgattggtataagcacttcagcgagagaatgcagttgtgtaagtaaaatatattacttctagcaagggaaatgaagaatcatagacatggtaattggcattgcttattgatgattatttccatgatgaatttatggaaagttgaagtttgttactatatttcattttaacttagtagaataattaaaatttatacagaattttatttagaaacattgcataattttcttatctttgaaaggttgttggaaacctatttgcgtaatgtaccaaggagcgcatcatcgttattatctatcaaggttttaattccttgagttgatattagtaattcaaggcttgtaataaatttgatgggagtcataaatttgcattgctgttagataaccatcatttctacttttcattttcttggttgaggcatttgtttggtattggcactgtataactcgacgcttatgtatgaatcttttgtggataccactacatcccataatcaaaacaattgaatgtgttaaatgcagaccatttcttcaaaaaatgtttgatgcaagttttatcttgcatgacatgaccatgggtgttgtagtcaccttaatgatcattaacaaatatcggactattatagaagatccagctttttcacatagtaaaatatcattgttaagatgtcatcaatggctgaatccattatcatcaaggaaaatgaaacattgaatagcttgtcatcattagaaatttgaaatctttctctcttaacacattccttcaccagtatttccttatgcttcttcaaatatggacatcatatcctctcgctttgattatgtaccataatctcctctttatgtggattaaaggccgagattatctttattatcaatagcctcaaatctcactcaatttcttcttattttaattttttagaagtgtttttattaataatttattcattactttagataaatatctcctcgatttaagtggtatggaatacgaaaagaagaaattgaaaaaaaaaaaagatgaaaaagttaaaaacaagaagactcaatgtaaggtacttagaccttattaattttctaaaatactggtatgtggtattttttccgaaaacataactagtagctatttttaagatatttttgtcatatatgtagcagacttctaaagtatagttggcaatcttgcatgcaattcctgttaaaaattaattttcatattatattatattatattatatagataaatttgtttagtttaaaaagtaaacaatccaaacaatttaagaagtagcatgaaccgtccaacaaccccacgagccaaaaaagcttactaatatcttatcaagcaattttgataaaaataaaatttaattaaggatacttttcattcacaaaatcgaaataatttgaattggaatcaaaataaccatatctctagagatgtttgactcgtgattgaaatcaaaattaaaaataaaataaaatttaaatactagaaagagtaggcatatattttgaaggattgaggtatttcatctcttttcgaaattaaaatgaaaataaaatttttttcaatcggacagctttaaatatagattgttcattctcattctcatcccaagtccaatctctccgatcaaacatgctgcttttaaattggcagttaaatgtatctaattaaatttggtgcaactcaattaggagaatatatgcttaaaagagttagaattctcatttgactcataatcttcaaattcaaattagctcaaaaaaaatgaatgcttatattatttaaaaataaaaaatgattaaaatataaaaatttatttgactaattaaatttgaggaataaccgtccacctcttgtactttacattgtagtgactgacggctcatctccgtggacatgtagaaatagtaatatagaattcattcttagaatgcatgcaattgcaatgacagcagtgctagaggtggtctcacctccatcgatgcttgcatctatcgtagaggtgaaagtaaaagcaggaacaatccctctaattttttattgtcaaaagatttgtctatggagactatattcacacatgcaaatgtacttgtccaccatcgaatcatcttgacattcgaattttggtagaatttgatggtggacattcgaattttgatggaatacacggtcgatctgatggtaaaaaatcccattcacgtagctttccgaagtccaatccttatcaaaaatggtttagattttgatttattgcgaaaactagaattcttggcgcctctcttaattattactgtccacaattgttgctaatgttttattagatatagttcttttattttttatataatttttgatatttctggatcccccccacccttacccttgtgtgcccaccatccctctacctttccatagttccaattattttaaatcaaaacaaaaataatttattttttcataatcaatcaaaaaataattaatctaaaacaacacagaaaacttaaataaatccaccccacaagatatctacaacatccacaaccactcatttaccatagtgctccccccgacatttttctcccaccaccctgccttctacttaaaccactcaaacccaccagccctctccccatccccaaaacctcttcaaaacctccgaacagcgtgaaacccagaacctagaagcccattatcctccaatctggcgaccatggccacctccaccctcgccgccaagcccaaaactcccctcctcgaccaccaccgctcctccttccacggtctctccctcccctcccgcgtctccgccgccgccgctcgctcgcccagctcctccagcctctccatctccgcccagttcacttgcaattggaacagtatttaactatgaagcttgcttgctggttcgttagtgaagtcccttggtgacggtaaatttttactagactttctatcaggagactagaagccagttgcaagattctctatgatcttgtttggtgttgccgccaaaattaggccccaatcatgaggtgattggagaatggtgttgatgaggtcgccctgtgcaggtgaggttggtgaagatgctggttggattggcaaagccggtttgagttgaagatggtgtgttggagagagtgattcgccaagattgtacaagtagttgtccaacctaaaacaagaactaaagtatacttgccaaagtttgcccagtgcgagcatttcgatgtttaagtcgggtagggaccttggggaaatggtggagatttaagagagggtggcttgtagtatggagaaagcatagagaaagtgtaaacaaagcgtatccgaagattccccaagtgctgccgatatatggtgagggtcagtgttcgttactgtgtaaggttacgtgcgctattattgcttgataaccatctgtgtattatgcatgttagcttaacgatttgttaatacatgccacgtggtgaacttccattggttggtgatgtggtggatttttttttttaaccttgatcatgactgaagtgaagtcaccttggcaatgtccaaccaattcaccttggatgcgaatgaattaaaagcacgatcatgccggcctgagattagcagcggtagttatgttcatttggccattatcatgtaattaaagtgaccataaccatgagatcatgttgatagtcattactgtgcattaatcatgattgtagctgttgctataccgttactatacgtccaactcactttaataatgactaccgaactccctctataaaaaaaaaaaaaagtaaggataaactcatgtaagtcattcaacatatctcattcttttccgatgctcattatctctactgtttgttgaatttcaactaatttgagcgttgaaaaattttctactagaaaaactcaaacaagatgattttgtttaattaaatccaatcatcaaccaagtagtggcattcatactgttgtgcccatgcagcatatcaaaagtagaatgacttcactatcacctcggatataccaacctcatcttgatctcaaagtttagtagttatagttggcatgtgtacaaaggccaattttaagttgtatcatatggcatgagtgaaacgaagggttaagaagaatatggacttatctcttctcaccttgtgaaacctatcacgacccaaatgctaaccatctgccaactgtgcctagcgcacaacctttgcgtagctgcatttcatctcattctgaaattcgatcatatttgagtggcatctttcacacaaaaaaataattaatttttttaaataatattcatcattggattatatctttcatagctctcaaaatagatgaatagcccccaaagcatcccaacatcttcccttcccatcaatgattgatgtcatgagagaagatcaaggattcttcgaggatacaaaccaaaccggatcggacccacctaatatgaaatgtgcaggcctggagcttgggatatggacgagctcgagggatgcctcaatccacgagccctccgcggctcccaacgcgcgacacgtaatcttccagaaagtttggcaccatatcccacatctcgtcggacgatgaggccatccgactttgctctctcggccttatccctcattttcgcacctcgcgagtccaatctcttgtaactgtttccgtcgtcaccaactaacaaatccaagctctcgaagtagggaatccggacacaaacaaaaatattatcaaattcaccaatttggagcagcccagaattatctcaaatccagttgactaatagttctttgtgatcaataatttaatgcctggaccaattgatgcaagaggcgtactacgttggttatgtccaatttatgggtcatgttttacatgtcactccaaccgcagaagatttctgcaagtaaaatataccaggatagatataaaatgtgttattaactttgcgactgcggccaacaccctgttcacaatgcttaaaatgaaatgggaaaaaaaaataaaattactctttagcctgcaagattgttgaatcattcttcaacttgtttgaagaggatggcatctaagatttcacattggaacaagataacaaattggtttgttttccatgattgattttattattttctagcatgcagtgctatttctctttaatgcctctgtgtgggtagatgaagcccattggattttgctcgtgttatttttaaaacttcccaatattgatggtgggatttgatcttttgcttcaccatcaaaagaacttatcagcagtactctagttggctcattcactacataacgcgacctcattttatagaatgcaagtttggataaacttgatcccaatattcatccattttgatgattgcaattgacccaactcatcacacgatcgaccatgtgaaaaatatacataatagatgtacaagactaataagaccataaacaattggtgacttatgtaatgcgttaccgctgctggtcctgcttctctttttggataaattgggatgctcaaataagaaatccgagaatagatagaaaggagtaagcatattaggagagaagtgattgtatatcttgaggatgtcctgtgagcctctatttatagatagagtctcaatagtcatgagagagaagaaaaatcagacacttagtctgatcttattgggcaagatatgcttgttatcttctaacagataaattgttatctctgcctcatcgggaatgctggctcgagaaggagaattgatgattagtcctgcttttttggatgagatatatttgttatctctttgtctacttatgatagactatcacatggattctacgattttctcagttaaaataaatcggataacaacattaaatatagtattttcttgaactatcagtttaaattgatcattatcaagatcagactgataattaagaaaagaatttactatccatatcaaggtgattaatgatgaaatctggaagatttctgccacatcaccatccaaaaacctacaccccagaaaatcctaacgcccacagaatcgtggttcttaaatgataataaataagtcatcaagtgtacaccaaaaaaagaaaacaacaattcattaagtgataaacaaataggggatactaaatacttgcatctttcatcaaaaaaattacatacatgcatgcgtcaagtgatacaattatatggtcatggttcatgcatcaaagtgattataaatacatagttctcggtcatggttcatgcatcaaagcgattataaatacatagttctctagtctatttcatccaaaaaaaaaaaaagcagagctaagcttgaacaaatagcatagcgttgctacaatctctcccccaaagagatggccaagttctcctactttgttttggtcttcctcctcatcgtctcgggtacgttcgttctaaccatcttcatgtactgctcttttaacccatagaatattcatctttctatgctatttttgaaaaccattcgaatgactatttccattaaacgagttcaatggaaagatctaatcttttctgagtaaaaaatggtgaagttcaatggaaaatggatataaaaaatagatgaggtctacaaaagttttgttaaatttttttccatcaaaattgttgtggaaatgctataattaaaattgcagattttaccattacatattttactccattttatagatgtgtactatgttatatgctatattatatattgtagatataatattatgttagttgagacttgtaggtgtgtgatataatttatgatggagacgatccaggtttagccaagatggtgccatccccacgctatatctttataagaaaaataaaaataaaataaggatatatttgattgggaagatatgaggtttaaaatgggaatgggaacgagtaactttcattccaactatttgtgtatcattcaatttttgagaaggaaaaaatgagaatgattcaatcccttcaaaaatccaatccctaactttccttaaggattagtcattccaatcacatatgagtatgaatcaaatatgccgaaaaatatgatcatcacaatttattccgattctgatttttattctagtcatgaaccaaacacattctaaatatattttcgatggactgacttatatatctatacaaatttaatacttggatataatgatatattctgttgagaccttggtgcccaaagtgagcatgacatatgtgattactgtgttatggatcatggctgccctgccaaagcttgcgttatgaaatgctgggatttggaatattaggggtgaaagtgatatagataatattcatctgaatatattttcgtatccgaatcaatccgaatataaataaaagtttgagaatctgactaatatccatattcatgtccatgttcattgaagaaggatatgaatagacaactatttgatctgtatccgaatatcgaatctatttataactttatataattttatataatacttattaattttttaaaaaatatataatcatataaatatattctgaacttgatttatcatctatttagtaatatttttaattttatagtcataaaatttaattatctaatttatattcataattatattcatatttttaatatctaaattttatctatatttatttaaaataaatataaatatatatttttatatctaaataatatttatatttatatttttattcctcaatcacaataaatataaatatagatattttgatatttagaacgatttcagtcccatgggataccacgaagatgcaacatgttttaaaaatcctgagactatcgacttgggatgcatgtgtgtcggtgaccgtgctgcacatgctccaatgtcccaagaatggttattaaaaagagtgccgcttagcatagccctcaacttatctggaacaagtgcagaaccgagattttgcacgccatgcatggatagattgatcgcgaagtgatttattctctgttttatccctggctatgcacaaacaacttagtccggtgtgctgagagcggacgaagcattttcctatcaaaaaataagggcatattatttattatgactcttgttttctgctttatcttgttttggcatgtgcgatagaaatgttgttatagctataggactgtatgctcatgactgtagatttcatcttatacatgtgggacattttatcttgttatagcatcccatgaggtaatgcactgcagtgcactaagcttgcaaagatctatcaaccaatagcttgcttggaattcaatagttttcactaaaacatgattttcctttttctaagtttattgaattttaaggaggaaggaaatggcaaaaatatttgggggtttgacaataatctcagctatcagattgtttttttttttttttccatttagtttcttaagttagaggaataatcccagctgtcaaatttttattcatattcaaataggtttagatatgaaaaaatattccggcagatattttttggtcactttcatccctagtccaattttttcctattttttctcttctcttcatttaataagtgtggtgatagagatatggaaccatttgtggaaatccggaggccacagcccctttatttttttattttttatttttgtttctataagacctcaattattctctctcatttactgagaaacctatccttgggaactagctttaattaacctctgcatgaactgcaaaaccaacaaaaggtttcatcagatcaaatgaaatcttctagagaatcatggatacagtccaaatgaaaccttaataaaagatttccatgggatcaaatgaaatcttcaaaagaatcacccaagcagctcaaatgaaatattctaggattcatttgattcatgaaaaaaaattttctgcccaaaaacactacaataaaacaggttattagcaataaaaaattttcatcgctaataatcaattttcatcgataataattattaacgatgaaattttcgtcactaattattcgttgcaaataatcgcatcgttgatagtattttatgatgaaaaaaatatttcatcgctaataaacgatatttacgataaaataattttcatcgttaaacaatttttattgaaaaattttaatcgtaaaaaaagtatttgcgatgaattataacgtcgctaaaaataaaacattaatagcgacgaaaattttttcgtcgctattaatttaattaaaatattttttgaaataaaatttttaaaattttttagtgatgaaatattttcgtcgcaaaaaatattttttacaacaaaaatttttcatcgctaataatttaataaaaaaattttaaaaaataaaattaaataatattagtgacgaaaatcttacgtcgtaaataaggtaatttttgataaaaatttacgtcgctaataattatttacgatgaataatttttcatggctattaattatatttaaaattttaataattttatatttattaaaaaaattaaattatcgtactaaaatatttttggcgatcaatatttcatcgaaaataatttcgtcgctaataatttatcatatttttttaaaaaataatatatgaatatatttttttgatttatatatatcatattttttataaataaaaaattaaaataaaaaattatacaataaatagataaataaattttattattttattatattaaattaagattacaagaagtttcaaataaaataaaaaagtacatgaagaagccgtcaagtgtcggcatctggagaacgagctagggaatgggagcgctcgaaagaacttggaccggcctgttgctgtctcatcagctgtatcgtctgctctatctgcgtcatctgcttcctcatctggatctggagctgctgatactcgtcgatgcgtgcagccaactcttgagctcgctgctcagtctgcctctgcacttctgtcagccgagcatcgtttgcagaatgaatgttagtcctagatgagcgtgacgatgagggagcagtgattccatatcctagactcctaatataataaagtctcgtaccaaacatctgatcacaaatctcatcatctgtgggtgcgatcgagcggataggctggaatctcatgtctgtcatatagtcctgaaaattaaagttatagctattttaattttataataaaaattagactgcgaacgaaaaaataattgaaaaaacttacaaagagcttctgactctccgtcgtccactcctctgaccatcgctggtgggtccgctggtagatatcgattctattaggaagctcccactctcagcatctctctataatttgagaattaattaaaaattttttaaataactacagaattgtatgctaattaaaaatttaaaattatctatcatatgctccatgcgacaagcgaacgacctcgaaccaccataatgcggtacagtcagtctcgcctgattcgcgatattttggacacatcttctctgtacagttactagtcaaattaatagataacaaatttaatttaagaataaataattcaatcattaaattttaaaaaaaaaagaagtttggatgtataacctgatatgtcggatcctcgtaatgccggcatatgacagccagtcattcatagtgatgctatcatagggctattgccgcactaccttcttcccatgatcctgcaccacatagtaccaatgctgatgcatgtgatgacgataattcctggaatgcaacgataaatgagtatctacggctcgcctcacacgatcctcctcaaaatcaatgatgttgaatacaccctgccaataataaatattagnnnnnnnnnnnnnnnnnnnnctaagttagtagaacgtgacgtcaattgaagagcgtcatggggtgaagagcgtcacgggggcataactgcggcatatgatgcccagctcagtctgccatagctcacaccatctcctaatggatttggtgtagtcggctggtatctcgatccggagatgttgtctcagatgctcgtgtctccaatgctctagagcgaggctcttcgatggatctgaaataataataaataaattattagtatgatctaaataaaagagcccgacccatcggctgctccacgtcggcccgaccaggcctcggcaccgtccacgtcggcccggtggcccgacaaaagaacaaaaaaaagatggctttctggtggcgtacgcagtccctgtcggcccggcccgtccccgttggcgtctcccccatgcccgatggcccactggtggcccgagaaccccccccaaaaaaacaaacaaatcgacctcaccttattggcaacgacgatggcgatggcggacgcgatggcgatggcggccggaagagggggcagagcagagagggggatgcgggggggagcgtgagagagagcaatggagggggggcaatggggaagaaaataggtttcaggtgggacttgacaggacgcattgtattagcaacaaaaaattttcgtcactaataatcagatttcgtcgttaataatttaaacaaaaaattaatttataataaaaaaaactattcatcgctaataagattattagtgataaaaataatttttgtcgctaatagttcccaccaaaaaaaaaatctgttgaaaaagctccaaaaaatattatttacgataaaaacaagtatttcatcgctaaaaatttttaacgatggaaattttcgtcgctaatagtttccgtcaaaatatttttcagtaaaaaaaattttttcaacaaaaaaattatttacgatgataaattttcatcattaattatcttattagcgatagaaattattttttttcactaataattacagaaaaaagaaattcttatttttttaaaatttgtgttaaattaatatattactatactgtccatgtctcgagtaaaatgaataataaatttttataaaattatatatctaaattcttaatttttatatgaatttgtgatgatccaaaccttgtagaagttctttaattgtgatcctattcctagctctacttaaatatctaagatttcctcgaaacatggcacatgttggactcaacaaatacccacacggatcttaagaaaattaaattttagtcattaataatcttattagcaacataaatatagttttgatcgaaaataaattttgtaaaaaaaaaattcaataataatttcataaaaaaataattttagatttttctcactatgaaaattttctatcaaaaaatttaacaataaaaaataacattaaaaaaatattcatgatgaaaaataaaatattaataaaagaatttatataaatagttaatttataattttttttctaaaaaaattatgtacataaaaaaattatgtatgcaaaaaaattatgtaatcatataacgtcagacgagaaacgttttcctactgatacattgcagatgttaactaacaatcaaatataatttataattaaaaaatttaattaattagatttatttttttggtgataacactgccatgagttgatcgaaaggtttgaatggacatccaaactcaaatttaatccgcgagcagttaagacatttgagatccgatgcaaaaggagcatagtagaaaagataatacctgctcaagagtatgtcaattttaggataaatcttgaactggatagcaataataagagtttagctagttcgagagtatctgcggcaaacaatcatcgcataccaattaagatcataaatgcactcttgaaaaataatactgaagaacccagcaaagaccttccgcatatagtttagaagtatatgacataatttagtccatagaacagttgataaagttttattctttataaagatcaagtaccatgtgaataaccattttgtggatcatatttttatatataaagatccagtatcatctcctttctatgttcttgggcagatacaaggcctttatactttgtgaccttaggttagtccatagaatcaacaatctatgtaaaattgagcaatgagacagattcagagaaatttagagacaaaatgtattgtcgtaaataatgatcaacttttgattttttttcattataaataatagattatttatgataaaaaatatgttttcatcgcaaatactaagttacttacgatgcaatatttttatcgcaaataatctataatttttatattttttaaattttttaaaaaatattgataacgaaaatatttttattataaataattgactatttatgatgaaaaaaaaattttcatcgttaataatctatgatttttaaatttttaaattttttaattttttcatctattagcgatgaaaatttttatcataaataattagctatttatgatgaaaagctgtttctatcgtaaatagtctgtaatttttgaatttttaaaattttttattttttcaagtattagcgacgaatatttttgtcgtaaatagtggattatttgtgactgaaatcatttttcatcataaataattaagtatttacgatgtaaaattttcatcgctaataatctgtagtttgtgaattttttaaattttttagtattttttgtatatttgcgatgaaaaatttttgtcgtaaataggtgagtattgacgacgaaaaataatttttcatcgcaaataatcatgtttctgtgacataatattttagccactaataatttacagcttttgaatttttatatgtttgaattttttcatgtattagtgatgaaaattttttatcgtaaataatttactatttacgatgaaaatatatttttcatcgtcaatactcctgtatttnnnnnnnnnnnnnnnnnnnnnnnntgatgaaaaatttttatcgtaaataattaatatttatgatgaaaaataaatttttattgtaaatactaagattatttatgataaaaatatttttatcatgaatatttgaaaatattaaattaaaataaatattttattatttatgatgataattttcatcataaataataggtatttacgatgattctttttttcatcgtaaatactaagattatttgtgataaaaatatttttattatgaatatttaaaaaatattaaattaaaataaatattttattatttatgatgattagtttcatcgtaaataactagaatttatgatgaaattttttcatcgtaaatatgaagctatttacgatgaaaaattattttcatcataaatattaaattattaacgataaaaattattttttatcgttaatatacttatttgcgatgaaaatatatttatcgtaaataaatttatcacaaaaacatacttttctcatagtgaaaattactttttagaaatataattttgatatgtttggttaactatggaaaattgacctatttcaaaatagcttgtgtttagttaaacattcacttttagaaaaactatataaaatacctattatattcttaatagacataaaatcataattttttgcccctaaattttatataaataattatattatatttatattaatataaatagaatattaatatattataatataacattagatcataataattttttatattataatactaatatatatgtattaataatatattaatacaatattaaaattttaatattattaatataaatatgaatataataataatatagtactatattaatacaaatattagtatataaatataaattttatattaatattcctaaaaatattatattaatataagtattagaataatattaatatattataaatattatattatttatataaatataaatattatattatattaatataaatattagtataatattaatataatattatcttaatatttataaggataatatttattggtattttcaagaatttctatgaaatgctctacaatcacatatttataaaatgatatttttgaaaaaaaaattattaatttttattctattaaagttccaaaactcatttcctacgtaagttttcatttcttatgaaatgtgggaagtacttttttatggaaagaattttttttattttctctcctcttaaaattccaaccaaacaaaaggcaaaggctcctctccacttttcagaaattgccatttttctcctctactttacgcgaaccaaacgaatctttaaagaatcgtgaatcaacagattactccataaattagatgttaagatccaatattaataagcataaaaaatccgtgggcctcaaaatctaagctcacaaattgcggtactactatatatcgtgagaaattgttgatgatttgcttgactctgttgtatgtatctaggtatgtaccgacgtgtttacttgtttatgcatctattctttcatgttgaatcaaatgtaacgcttgcaagttgtgatgtaatttagttgagatggtggtgcccaaggtgactgcagacaattgtgtttggattgtttcggacggtggctgcacgcctagcgtttgcgcatccgaatgcaacagccaggggttcggtgggggaattccagagtgttttctaaatgcagataacaaccagtggcgatgtggttgcgtctttccatgctgatggagcaatcctgaatgagcttcgatcaataaagcaataccatactgcttcttcgatataataattttgttaatgaaagcatatttttttaagtatgtctctgctttatgctttttttttttcttttctttttttgatgaaatgggaggttgcccacccagtttattagaacaatcaagaaaacagaaacattatatcaccatgttgggatgcattttgaggtgctaacacgaagaggcctaccgaccaatagcttcaagcccaataatcttggcacataagcaatgaaactattctatttttttggggtttggaatcacaagctcttgcttttgataatggaatcctcagcagctatagaatccaaaatagccttgatggttagtcatccaaagaggctgatcatttatacacaaaaagaaatacttgggtgcaatgcatgtttgaagaagaatttgataaacaaaatctcttgatatgtttgatttgtgactggaatcgaaatcgaaatagaatttagagtatatagatgaattttaaaggattctaacatgcattctatccctccttcagtattagaatgaaaatgttactcttttcaatcaaataaccgatatataagttattcatttttattctcatcatagagtccgactctctctaactaggtatttttttagcaaattggcggccaaatacacccctacaaatttggtgcagttcggttaggaaaatatatacttaaagagctagaattctcatttgactcgtaaatttcaaattcaaattagctcagtacaggtgaatgcttgtattatttaaaaatttaaaaaatatgattaaaatatagaattttttttgactaactagagtcgagaaataactacccaccccaagtacttcacactatggtgagccgatgattcagctatggggacatgcatatgcagtgatgtaaaattcatgggatgcatgtagatgcaatgacagcaatactttaggctgtcttacacctgcatcggtgcccgcatccatcaaggcgaaagtaggaaacgggctccccaaatgtatatttcctaaagcgatttagattctgatatgttgtgaaaattagaatttctgatccctctcttaattataaccatctataattgatactaatgtttattggatttaattttttaattttttatgtaattttttaatatttttggatattttttgtttctcccttacctagatgtgcccactatttcatctctctttggttcagatcgaaacctagatatccagatccagacccaatcttagttactggtaccggatccgaatccgaatacccgacaaatctggtcttgaagtaccggaccaggactctaatagatctcaggtatccgaacctgatttcgggatccaaaactcctcgtcataagcggtccgaatggcgacgaagatgatgtgaggcagaggagggcgtgcagaatggcggagccatagaaggcaatagcggagggagagaggcggctcggatggcagtggacatgatgcgaggcagacaagtcgatgagactaagttctcttcaatactttggtttccagcttaaaaaaaaatggccaccaaattaatcgacgaaagtcaaatcacttttctaacccaatacagtaggttcataagcacttttccaatcaaaaaccatgataggagctgatagacgagctaggacacgagtagaggctataagtattatttcctcctagtcaagtcaaaacatcaaaataatcgaaagggatgaggaaaaaaaagtaatgaatgagtattgaaattcctaggatcagatgacttcttccttcactcgacgaaaagaaaagaaaagaaggaaataaagtaattccactcgacttctcaccagcatttcagtggaagccgaaggcgaaaggaagaaggcctggcatgtcttggtatgaccaagccaaaacatctttgtagctctagataaaacttatcatgacgagcctctgctttggagataatgcagttccgatcttgacctccttggggtcttcagcgattccgagattgagtttctcgatagtgggtttggggtcctggtcttgtcttctttccgactaaagcttcaagtctcaattcgaagctaagcttgaccatctactgactattgatgaagtgatgaagtgtgaaaattttatgaatagcttagtaagatgacatcactttacttttttatataatgaagtaagctgatctccgactgatccattctatgaggccttgcactaagcacatactcagatagggtcgtgaagtgcaaagatctggtctttgatagctcagtaggatctagagaaagacagatcaacctacctatctatttttagtggcaagatcaatcaaacaaaataggctcaagagaagaatctattttcttcttcttcttcaactatatcccatcatatacatcaccctcgattgggctggtggttcttttcgttgccttaataagtattgtttcaactccagccggggtgggtgaatagaatagtaggaagctagcggcgcataatttctttttttagttttcgctggctttccaagaggggacaggaatttttcctagcccgagccacttcctctgtagttgtcagctcgttcttgataaatccgatcggatgttcataatctagagtaaaaggattcgaacctttgcccgcctgcttcttccataaacccgatcatctgttaacgcatacagcttcccgtgcctttgccctctagcaatctccatcctcgttctgagatccttcacaacaacaataggagtcaaatcaaacttgcatggaaaatcagatgtgaactaactgacagatagaagactcttcttgaaacgtgtttttcaatggaaatcagcaattttttcagattttgagaaattgatacgaagaagcaggatatctgattgcattctgagtagccatctaagtgaagatgggagtgtttccgataatggaggataatgagctcttttgggttgcaaggctgctttggtctactttcaaggatagaatatcgcccttgacttcgaccaaactaccatagatagggacatatttatttatataactatgcacctaaattacctcttttcctcttagcctcaccttcggtgcagatctcgcgggggagaggctagctggatctcctctgtccacagctctggtgccggggtctggccatcggtgagcatgggtgtttacaacgaaggaggtcttggcctcgcggtggaaatcgagcatgggggcgaagatggtgcggtcgtagccttgatggaagcggctagaggatgggggctcggaggcggagaggatactgagagtggagggtggagatgtagatctcagagaaaccgatctcggccaaggtagcagagaggaagcacatggcagcgaccaagtgggtgataaggttggggtgggcggtggccatgacctcgttgctgacagtgaggaggggcgagtttgggtggatcggaagtgaggagctgatggagggagtcgagggccgacgtttggtgtcgggatccggtcgtcggcgagcaaatcgcggcggagaggaagaggcaccgtcatggtccttgaggagactaagagactgagagagaaggaggaagaaaactgagagacagaaagaggatattagatgggatattaaatatttttaatatatatattatattatattatcagattttggatctaggtctggatattaaatatctataccctatccatttataatataatttatcgggtccagatctggatttagataaataggtccaatgctaatatcagattcaaatccgtcggataaatatccctggaccacgggcctggatccaacggattgtgagctttactttccacggttcccacccaagtatctcctgcagttagttaatcaattattttaactcaaaacaggaacattgtatctttttcataatcaatcaaaaaataattaatctaaaacaacgcagctaaacttaaataaaaaccccaccccaaaaaacatctacaacattcatagccactcatttaccatactagtgttcccccatgagatttgtctcccaccgcctcgcctttctacttgaaccactccaagccactcgcgctctccccatccgaaaaacctattcaaaacctccgaacggcgtgaaaccttgaacctcgaagccctaattatcctccaaaatggcgaccatgaccacctccaccctcgccgccaagcccaaaactcccttcctcgaccaccgccactcctccttccacggcctctcccccccctcccacgtctctgccgccgccgctcgctcgcccggctcctccagcctctccatctccgcctccaccgccgaccccaggtatgacctcaactccatccgcttcgagcccatcaaagaatcgatcgtctcccgcgagatgacccggcgatacatgacggatatgatcacctacgcggacaccgacgtcgtcgtcatcggcgccggctccgccgggctctcctgcgcctatgagctctccaaggacccctccgtccgtgtcgccatcgtggagcagtccgtctcccccggcggcggcgcctggctgggcggccaactcttctccgccatggtcgtccgcaagcccgcccacctcttcctcgacgagctcggcatccctacgacgagcaggacacgtacgtcgtcatcaagcacgctgcgctcttcacctccaccatcatgagccgcctccttgcctggcccaacgtcaagctcttcaacgccatggcggcggaggacctcatcgtgaaagaagggagggtcggcggcgtggtgactaactgggccttggtgtcgatgaaccacgatacccagtcgtgcatggatccgaacgtggtggaggccaaagtggtggtgagctcctacgggcatgacggcccgttcggagccaccggtgtgaagcggttgaaggacatcgggatgatcgactcggtccctgggatgaaggccgtcgacatgaacgcggcggaggatgccatcgtccgcctcaccaaggagatcgtccccgaatcgtccgcctcaccaaggagatcgtcccggggatgatcatcaccggcatggaggacgccgagatcgatggcgcgcccagaatggtagcaattccatctttacgtgtgttaatggaggcaagattgccaagcgttgttgatgcgttctggtgtggcaggggccaacgttcggggcgatgatgatttccgggcagaaggcggcgcatctcgctttgaaggcattggggaggccgaacgcgttggacgggaccatcgggaccgagaaggtgcaaccggagatggtgctggcctcatcggacggacggtgggaatgtcgttgatgcttgagtagctgtgaggaaaaataatagagggagaagggaagggtggggctgtggatgaggtgaggggctgttatgtgtcaatgttgagaagtgaaagaaacctcctctgcgtcgaaacaaagaaaccttctacaaaaaaaaaaaaaaaaaaaaaaaaaaaaaaaaaatactgaaacctctgttgttgttgttgtttgttttttttttttcttttctggcaattattgcttgttaataatattagtattcctctttctttagtccataaataacttgatgttgcatgttccgttgtctcgatttattattctacgtgtatttacgattcttctaatgtaccctgttggaggactgttgtgctgttctgcttgctctttcttcactggggtttcggcaacttcggattggcaagttctgttaagagatggttccgtgaggaaagaagaaaaaaaacagtggactcgaacggaacgttcggtggaaacacagccgtcatttcccaattccatgaaacatattacaaacaacatttgctcggtagaaatgaaatataaggacaggctggtagaaagaatgattgatctgaatctattttgattttttcttcacgtccgaccttatcgcatagagaagagtgcgaccccttccgtcggcccccctccgttctcgtgcacgaccctttctgccgggcctctatcgctcgaccggcccttcttcatccccgctgccctccgccgatcctcctctatccttgcacgagcgggctctttgcatcgatctcaaaacgccaagtgccatcggatggtcgagatcgcgaaagaaaaatctattattctgatacaacccgaggggatgagcgtaggcaggtgcagacaaaaaaaggtggggcgttggaagatctggtttctagtaaagtggaatacgtgacggtacaatacaagaactgtatcgagagaagcgagggcgcaaagtataaatatctgatagtttacatgctttataaagtatcgtttttggttagcacttgtattatgccaaaatgtatggtttaacaaaatccaacaaaaattaaattttactgacttgctttgctttggcgtggttataaccaaatggtccaagttcaaactcgcagtataatgagatttcggaagtttacaaccttcagaggtcaagcttgttttcgttgagatatacttgtgcaacatgtttcatctgcttgctgaacctgtactaatgaggtatacttgtgctacatttttcatctgcttgctgaacctatactaatatatagttaagggtgatgagagactaagagagtttggaaggggtagagcacctcaaatatgatagcggaatctctgttagctccaattgagatggtgtttggtagcatataatcttcacaggattatatataattttacaacagataatcagattacactatttgcttcatcactttcacaagtaatgctacattatatgtaatgttgcatttcatataatacaacattatcttaaaaaaaataatttgattgtctagagagagttgattatgtgattatatgtaatcttgcaatcctacaattttgtaacaagataatttcagatccaaagtactctcatcaaaataaatcaaaacaaattatggatagttctttttctttaaaaaaaattattgatagtcttagttggtgaaaatagaaaaaagacataatggggtgatgtcatgaaaatagttgatcccaaaattaagttgttcctctagaaaatagacaataatcaataagtaatggaggtactttgaaaaaattagtttatattctatataatctaaattacatatcaaacactgcaacgtaggattttctataattttataataatattactgcacatatcaaacactacaatataagattttctgtaattttattaggtaatcatatttcctctacaatcatattatcatagcaatattatttatgtaatgtactaaatgcctcctgatggccatcttacacgctgcttgtagctcagccaaaaaagcttaagatacatttgtttgtacttttttgaatagttatttccttttatgaaaaatacagcgggatattacttccataattcaaatatagtgctccttccataattcctatttcatttataatatccaaagttcttgtggatgggctacgcaagggctaaatattaaatggcgatcaaacaaggaccagttgttaagttttctggtaaatattgatccgactatgaaccacagtacacttctggcaagtcgatgagcctcctaatgataccctaggccctgcattggctccatttaggcgtggctttattattcttgtgggatacatcagggcctatgaatctgaagtggcttgacacagacctgtgactttgacaacttcaggccccaattgtaagttcaacttagcctcaaagagtctataattgggccaggtctaagaatgtttttgggctcagcaactgaagagcccatgctggacatcggcattgtcatgttttctcggaaaggaggaagaggataacgggagaaggaaactggaagttattgtgtacgagctgttctctccactgatcatgtaaactcatgagatatttgtttttaaggacttctgtctgcaatactatctagtttatccagagatttcataattagagtagtctcatgtggcggatttccattagatatagtaggcagatttttaattgtcacttaagatgcattgatgtgttgagggtgctagttggctcagtttgtgtgcgcggctgtatgagagagagagagagagagagaggtctggcaacatgtaggctttatttttttattttccttttttctctccgtatgtgtgcgcgtgcgcaacgtaaaggaagcaatccaaaagtcaattgtgaccgcttctcatcataagctagccaagtaggaacggtaaaattgatctgctttattgggcatgcatcctatctaaatttgattaaatttaaaaaaataaaatttgatcaagttcggattcaaatttgaatttagataaaatctgaaaattataacatagatatgggtaggatatgaatagtattattttctacccaaattcgaatttaaattcgactcgaacttacggatatgagtagtattcaaatatatatgtttataattctgttttgataattttattttaattgataatatgtataaaattattttgattatttatatgtcctatgttgaattgtaattctatttctatgtttgatttctataaatctggacttataaattatgttgtatgttgaattgaaaattttgttttgattgaaaatatgcataaaattattttgatcgtttattttttcggatatgagataagtatggggtggatatgggttagataggagaaaatggattatccgtaggtatcttcaattttattgggtatggagatgcatatctcttttcttacccgattacgtattggatagggtttgaatataggatattaaatttgagtttggagatcggtagcacaatatccgatctaaatcgtattcattgccatctctatagtcaagctatcaaattatttatttttatttatatttttttatggactaatggtgcagaagcacaaaagaaatgtaattggagatcagtagaggtgcttgggctgattcatatcccatttgattgcttgatgtcttacatgcttttttaattgttttactgagatttcttgtaatcattttctattaaactccaaacaacaatctcagctactcaggataatatatttatttatctcaaaaaagtttaataacttacattcaaaatccaggcactaaaattgatttttccgtatgattgttccgatcagaccgggttatcataccgggggtgagttggccccctgctcgttcgcttgcaattggaacagtatttaactattaaacttgcttgctggttcgttggtgaagtcccttggtgacggtaaatttttactagactttctatcaggagaccagaagcaagttgcaagattctctatgatcttgtttggtgttaccgccaaaatttggccccatcatgaggtgattggagaatggtgttgataaggtcgcccagtgcaggtgaggtcagtgaagatgttggttggattggcaaagccggtctgagttgaagatggtgagttcgagagagtgattggccaagattgtacaaagttgtccaacctaaaacaggaactaaagtgtacttgccaaagtttgcccagtgcgagcatttcgatgtttaagtcgggtagggatcttggggaaatagtggagattcaagggagggtggcttgcagtacggagaaagcatagagaaagtgtaaacaaagcatatccgaagattccccaaatgctgcctttataggtgacgtgcgctataattgcttgataactatccgtgtagtatgcatgtttgcttaacgatttgttaacgaaggccatgtggtgaacttccattggttggtgatgtggtagatttttttttctaaccttgatcatgactgaagtgaagtcaccttgacaatgtccaaccaattcacctcggatgcgaatgaattaaaagcacgatcatgccggcccgagattagcagcagtagttacgcgcatttggtcattatcatataattaaagtggccataaccatgcgatcacgtggatagccattactgtacactaatcatggttgtagttgttgctatactcattttaataatgactatcgaactcctctataaatatgaaaagtaagatactctcatgtaagtcattcaacatatttcattctttttcaatcctcattatctctactatttattgaattccgactgatttgagcgtcgaaaaattctctaaaaaaaatctcacatatgatgattttatttaattaaattcaatcgtcaaccaagtagtgacattcataccgttgtgcccatgcagtatatcaaaaatagatcgacttcactatcacctcggatataccaacctcaccttgatctcaaagttcagtggcaacagttggcatgtgtacaaagtaggggtgagaattggatcggatcggatataaacagatcggtcgtatatgggttgactcaaaaaattttgaatccggatccgacctatttatttaaacaggtcagattttaaaatccaaatcccatctacttaataaacggattatccgatccgatcagtttactatctatttataataatccattaaaaaaaaatcaatcggatcaatcggacttatttaaaagaaaataaaaacatgagagggttttgtcctgcctgatctccgtcagatcgctctcctctcgctctgcccgaccatcgcactatcgaccacctccatctctgcttgaccgtcgtgctgtcgaccgcctccaacttcacctgaccggaagccctcacctccagctttgcccgcagcttaaccgaaatcctagatgcatccagcttcgtccatagcctgatagggggccctcacctctagttgcgctcgtggcctggcccttaatgcgcccccctaaccctaaatctctcccccctccctcgctggctccaccttctcggccgtctccatcacttctttaccctcctcgactggtccttccttcaccgccacctccccctccggttccccacctcctttatctcctcttcctctgccacgaccgccggtgtcctcatgctggcctgtgcctgtgcgactgtgtcccacacaaagcccctcattggtgaacccttggaggggacgagaaaaccccagtagctgtggtcttggccttcggcaaacctctgatggcgtgaagaagaaggaaagggaagggccgaggggaagagaaaaaaagcatgggactgcaggatgggaacagaaaaatcaaggatagtgtggtgtgttatcaacaggatgttagtattttatgtggatgcgatccaatttcctacgtgtgggcggacgaattcggaaaaaagaagcatgctccacactgtaaaggctttcaataagttatgttatccgggttaaacagattatgtaacaattcgatccgatccaatccgatccaagatccaacctatttattaaacggattaaatggatcagctactggaaacctaaatccgatccgattattaaacagattaaacagatcaatccatttacgatccgaatccgtttaatacaaatataaatttatttaagacggatcgaatgcagattggattgacagatcggatcgatttttatcgctcctaatataaaggctaattttaaggtgtatcatatggcatgagtgaaaagaaggattaaaaaggacattgacctatctcttctcaccttgtgaaagctatcatgacccaaatgctaaccatctgccaaccgtgcctagtgcacaacctttatatagttggatctcatctcattctcaaatcagatcagatttgagttgcatcttttatacaaaaaaataattgattttttttataattttcattgtaagactgtatctttgatggctctcaaaatacatgtatagccctcaaatcaccccaacatcttccctcctaaagatcgtataagtcccagagcgaccatgtagccatccaatgagctcttaaaggccgtgtacgtcccggagcgaccatgtagccatccaatgattgacgtcatgagagaagaccatcgattcttcaaggatagaacccaaaccagatccgacccacctaatatgaaatgtgcaggcctggagcttgggatatggacgagctcgagggatgcctcaatccacgagccctccgcggctccgaacgcgtgacacgtaatcttgcagaaagtttggcaccatatcctacgtcgcgtcggacgataaggccatcctactttgctctctcggccttatccctcattttcgcgcctcgagagtccaatctcttgtaactgattccgtcgtcaccacctaacaaatccaagctctcgaagtagggaatccggacacaaacaaaaatataatcaaattcaccaattggaacagccaagaattatctcaaatccagttgactaatagttttttgtgatcaataatttaatgcctggaccaattgatgcaagaggcgtgctacgttggttatatccaatttatgggtcatgttttacatgtcactccaaccgcagaagatttctgcaagtaaaatataccatgatagatatagaatgtgttattaactttgcgactgcggccaacacccaattcacaatgcttaaaatgaaatgaaaaaaaaaattgctttttagcctgcgagattgttgaatcattcttcaacttgtttgtagaggatggcatctaagatttcacattggaacaaaataacaaattggtttgttttccaggattggttttattattttctaccacgcaatgctatttctctttaatgcctctgtgtgggtagatgaagccgattggattttgctcgtgttatgtttaaaacttcccaatattgatggtgggatttgatcttttgcttcaccatcaaaagaacttatcagcagtactctagttggctcattcactacataacgcaacctcattttatagaatgcaagtttggataaacttgatcccaatattcatccattttgatgattgcaattgacccaactcatcacaggatcgaccatgtgaaaaatatacataatagatgtacaagagtaacaagaccacaaacaattggtgacttatgtaatgcgttactgcagccggtcctgcttctctttttggataaatttctgaggtttcaaatccttttggagtggacttggactattcatcatgatcaaatttgacttcatcaagtcttggcagctgttgatgagagtttgttttcaccagaaagggacgcgtggccattgattgggcggctatgatctgttgaagcacaggtgtccatcttgctagtcacagacagttcatacgcaacaagagagcccaaagtgttaacttgcatgagctgatgaacttccaaatatttatgaatgcttttggaggtatgatctcgtggaggtagcagccaactacatcctaacaaaaaaaaaaaaaaaaaagaaaaaaaaagaaataattacatcataataaacatgttagggagatgaagatagtaagttgtcatcgccaaacaaacaggaaaaggtactagtctgttaagttttgttctattgttcttgggaaaaatgggcagttaccactccgacttttttccgaaaggatatggttcccttttcctttataaatggagagaatggaggaggacaccccgttcattcgttgcagcccttagcaagaactacctctcagggttcccccatggcttcatctttttcagtaccttcaatggttagttcccaaaactaatgtacgatatctcctttcttacttacttcccatggctgatttagtttttgtcgagagatcctaggattcattaattgttatgagtggtaggactgggtttctaatttctgatttctagttttgacatcatggcgtgtatcagaactcaaggaacttagagccaattgctcgaatgggattttgatctccagaatctgggcttggctaactcattcgtgcattacacaatgaattataaacgagtattaatttcatccttttatgtgcaatgcgagatatattttttcttatataatttcgtggacatggtactcatgctcgtctccaaaaccatgggttccagctactctggtatgtcatatgaaatggcttggaattttgagtgcaccaggcatgaaacatgcatcggcttttgtaatttgaaatattctatggcactttgtcacagaataccactagttttctttctcctttttcttcttatttctttgctttttggtgataggataccagtcttctatttatttgactattttcaagttcccgaattgatcagtaatgaattttccccataactctgcttttctcaatagtttcaatatttctatttccatatagagggattggagaataagctgacggtgacccatcatactatctcaaaaaagacagtagcgcatcaaactagtttatgaagtttctttttttttttggaataaaaaaggtattcgtttttaattttacttgttttgaacaaagaaaagtaccttccccagtaattgattttcctccccctgttcttcagtagttatctcccaccaacggatactttgcatttcattaacaggcagatttttcccttttttaagcataattttgggtgttatagttgatatagcttattggaacaagaaataaaaatgttttgagtgttcacatcaaaaaaaaaaagggttttgactgttgcattctataacattctatacacacgtactgtatatgtaatacataaaaaatacatacatacgtacataatcattagaaaaagacaatttgtgatgtaatatgtcgttccttcagaagaacacagttttctagttcagttaatagcacattagatacttgatgtgaagaaaacgatgcaagtacatagcatacgaactatagaatcgcaatcataacatggaggtggtgcaaaattgcgtgttttgccttggtaacttggtatcttaatgatagaccatcccattctcttagaaagacaggccagacttccttgaggtctgccaggatgtcaataacgcaaggcctagatctggtccagtgacaggcctaatccatgactggagttctgaacttgaagaaaatcttcagatgcttcatgaatcatgatatggattgatagatgcaaccattctatgatcaggattttttttgatacatatgatcatccagtagcataattaatttgtcaattggactgcagatcatggaggaagaaggccggttcgaggccgaggtcgctgaggtgcaagcatggtggaacactgagaggttcaagctcacacgccgcccctacaccgcccgtgacgtcgtctccctccgcggcacccttcgccagagctatgcctccaatgaccttgccaagaaactctggcgcaccctcaagactcaccaagccaacggcactgcctcccggaccttcggcgccctcgaccccgtccaggtcaccatgatggccaggcacctcgacaccatctacgtctccggctggcagtgctcctccactcacaccaccaccaacgagcctggccccgaccttgctgactacccatacgacaccgtccccaacaaggtcgaacacctcttcttcgcccagctctaccacgaccgcaagcaacgggaggaccgaatgagcatgagccgccaagagcgagctcgcactccttatgtcgactacttgaagcccatcatcgccgacggcgacaccggctttggtggcgccaccgccaccgtcaagctttgcaagcttttcgtcgaacggggtgcggcgggggtccatatcgaggaccagtcgtcggtaaccaagaagtgcggtcatatggccggaaaagtcctggttgctgtcggcgagcacatcaaccgtctcgtagcagcgcggctgcagttcgacgtcatgggtgtcgagactgtcttggtggctcgaaccgatgctgttgcggccaatttgatccaaaccaacgtggattcgagggaccatcagttcatactgggagccaccaatcccaacctcagaggaaggagcttggccagtgtattagctgaagcgatggcagccggaagggccggcgccgagctccaagccattgaggacgagtggctatcgatggccaaactgaaatccttctctgactgcgtcaagaatgcaatcactagcctcaacatcagtggagacgagaagcggcggaggcttaacgaatgggcctatcattcaagctatgagaagtgtctttcaaatgagaaagggagggagatagctgagaggctgggtgttaggaatctcttctgggactgggacttgcccaggaccagagaaggcttctataggttccaaggctcggtcacggcagcaattgtcaggggctgggccttcgcacctcatgccgacctgatatggatggagacgtcgagcccagacctggtggagtgcactaaattcgccgatggggtgaagtccatgcacccagagatcatgttggcctacaacctctcgccatccttcaattgggatgcgtcggggatgagtgacaaacagatggtggagttcattccccagattgccaagttgggttactgctggcaattcataacgctgggtgggttccatgctgatgcgctggtgatcgatacgtttgcgagggactatgcgaggagggggatgctggcctatgtggagaggatccaaagggaggagaggaacaatggggtggacacactggctcaccagaagtggtccggggcaaattactatgatagggtgctgaagactgtccagggtgggatctcttctactgcagccatgggcaaaggcaagaccaccctcccttctttactacatactcctctgtttaggtttttatttttttaataaaactaattatttttaattttttgttttaatattaggatatatctacaaactaacaataaattaactttgattcacatctatggccgaaagaaattaatcgttccattgatgaagatataaaaataagtttgaacttcaaagcatatacacacatacggacgcatatgcatgtaaatttgtaaaatggcaatgaatcaatttgtttctgtttgaatgatttacttattttgcctaatttagcttttatagaagcaattatggaaaattatttttgaaaattgggtctgcatggatggaattgcatatttttgttttggttattgcattgttggattacttttcttttggattattaattgcttatttaatggcttaaaccaatgaattaagttttttgatagagactccagtgaaaacattagagctaaatttactttagaaaagtgaaggcaatgaaatgaatattcaagatttaaatcaatggttaaacagttgtctatttatattttttttctttgtaactcatttcagtgttcatgcgagaaatccacacattttatatttgttgtttcttacaggagtaactgaggagcagttcaaagaaacatggactaatcctggtggtatgaatgatggcggcaacatgatggttgccaacccaagaatgtaaggagaatctgttcatgatgcaatgattctcttggattatgagggtctcgctagctttcttttagtacgcatgaataatactctgtaataactccatggagattgggctggttgtttttgatgtcaagcctttaggacctttgttacttaatttacggcatagaagaaatatgtctacatgtctttatgcaagagtttatgctggcacttgatagataatctagtatcaccttttatttgtaatgttcatacgatctcccatgtgttcaccagatcattttgccgtggtttagataactatttcatggtttattcatccgaactttttgtaacattcattcctattatttggtgcctatctgctcataaccgatgtctttttccttttttttttttttccgtatgtcttttcgcaaatgtgcatctatgataaaactattaataaacaccataagggatggagttctctagccatcaaaaaaataaaaagaaaaatagagataatatagagctttgaaagcatcacacacacacataaaaatttttaaattaataatattttcaagaccattttgaagacatacccgagtttctgggtgttgagtgcagtattagctttcttatctatcataaattctattggtcaatgagccacgtaatcatgtcactcgagcatcatcccaaataattgagctcttcccagtcttctttattcagttcagcttttataaaatatattcgaaattgagtattagccgttatactagttgtaataatggaaaaagaaagttaatatgagaaagtaatgattttatttgctcaagctactacttatcaatattattttatttacgtgaaaaaaaaattataccatcatcctaacaaaaaaaaaaaaaaaagctagatcacatctattattttaatttacacacagaaaaaggcaaaagaaagaaagaacgttgttacaacggccgttattgcaatcaccgagcctaggtcttactcttttttgccgcgtgatcatctcccccttcttcttctgttccggcgaccggcgtcgcttccccgtgccctctccaaccgcccccacgcttcccctcctcctcctcctccgccaccgtcgcctctgctcctctctccgagcacatgcacccggccaccgtcagtgcggtcgtcggccccgccttacccgtgtgatgtaaggtagcatctgttcgacggtccaaacctcacctcacagcccgtgctcctcttccctgacctccagcgcctctccaatccctttccatcctccgaacctcccacaatcaatcccaccgacgagccctcgccgcccagatctcttcacagctccgagccctcccttctctcccgtccctcccccgatctcttcctccaagttctctccttaactagatcccaccccgagatctccctccaattctttaattcagccaattccaagctacggctccaccccgacctccgcctccctctccaagatggtctaaatcctcgtcgattcggaccttctcgactccgcgaagcacattctctatccggcccttcgatccaagccagcgccggcggtgatcggttcgattagccgatcaccgccggcgcctacacctattctaactttcttctcgaatctcattctagtctggatcaattgccagttctttggagtctttcagaaaaattagggttttggagtgtcagccagttcttgatgcattatgctcggacgataggaccagcacggcatggtgtttctacgctgccgtcgtcagggctgggagtttgccggattccaatacgtgggcgcttcttgctaagcttctttgcaaggaagggaaacttgcgagggttgttgagctgttgcgtttgggttcttgtgatttctcgactcatgatttagttatagactgctattgtaggaaattggagttgctgcataaacttttcatttaaccatatctacattggatttttgctgccaagggtgaatttttcatgtaaatatccttaggcatggtttctggaaaaatattttactggatatttcttaaccatatttcttgactgattgagctgataatagctgtttgctaaaagtgtccactgtatctagaataaattcttccctctttcaaactttttccaatctaggaaaacacacagtccaaaagattgaagtaactcaatcgaggtgatatgaagggtttgaaagcagagggcaggactagggagacttcgacgaaagttgcgagaaatattatgaatgcggctttttcagttagtgaactgtgggatgagaattaccgctgaatgaagtaattcctgaaaacctgaacctacactggtgaaacaaacttaatgtttatattaagggttgcatcggaaatgatcagaattgtaaattgactagaatcagtcatggtggggacatgatcctagctagtgagtgaagcacttgaattgtaaaaaaacctaaaaacatgaaaataaattctggaagtgttggaatccttttcacctcaaattgctatgcttttgctatattaagctctttcctcaactcagtagtttgtctagatccagctgtttcatgggtcactatagttgaaaaaatcaaatgattttgatattattttgtcaaagaataatgcttttggtattgtttattagcaacattcagatgttccacaatacaaactccatgtgctttgtatttgttcaacctgaaaatttgagtgacacctttgtcataaagcctctcaaatgaaatatacaatcttcgctcacagacattacatgaaggagttttaattggttacaggtttagaattaaatttttggttcctttggtaagaagagttttggttttgattactgatagcatgcacaatatagcaaggacacagagctcttgctgactcctacaaacatcaagtgacagattcatagaattaatatatgcaggagaattttcttgggttgatgcctttgcaagtatgccttcatatgaaggattgacaacttatgccagtcctgttgaaatgtttctagatgaaattcacaattattattatagacattagaactgacagaatgcaaaatcataattttttccttaacactgtattcatgcttttgttatgctattttatcatgaagatgatgggaaacaatatcaattttattgtgttggagtatgaagagaataacattatagtcggtttctatttgcagacttcgaatcatgtgcatctgattagaactgacgtggcgcattacctcttctgcaaccatcactttgcaaggaggaggcaaatgtctgaactggaactccaggttagcattaaggttatggccatttatttcaagaactagaagaatctgtgcttcggaatgaaaatagttaggtgccatgccatctttttccatgtaactgcaaaatgaattggatgaagtagagcaaggtcatgagcgtttgctttctttcaatcatttcttccatggtttcaggattgagagcaaaatgactgctgcaatcaccagaaggataacaatagcaatcatcatacatttccttgattttttctgaagactttttgcagtgtggagggcttctgttccagactgtacatggttcacagcatttgacacctggaaagacattgcaatgtgagtaaagtagataaaagttccaaaaaaataaaataaaataaaataaaaagtagataaaaattgagaggggtgtacttaacttcgcgggaactaataaaattaatgattgagcttccttaacaaactaatgcgttataatatattcaactaaaactccaattaactgtataattaatgtgagggttgatttacattgtcgttggaaagcttttcaagaagtgagtagtgttcagtcactctgtttctgcttgctactataacgctatactagattaatcatcttgatggtggaactaagaactgacaaatctttcttactgttaaaagggatctgacagtaaaagttaatacagcatcatctaaatatcaaagagatacaaggaaatgccaatacaacaacaattgatttaattgaacatcatttgtaagtggagagggcaaattgccatgtcccctaaaaatttaatgcggactgcttgaaggtggattttgtggaagtgaggtaagcatcagtatttaagatcctagaagtgaaaccaaagatgccaaccttatgcagcataatccaagcatttggtacatctatgcttttagatcatgagtttgaaacctattgaggtgattgatgatttttggatcatcatatttagagtcctgtttgagtggtgcaaatttgtgaagcaatttggtgaggcagtgtttggggactttcaggccatgctctcgggtgaaatgctgagtatctcttagcagaagttgttgtgtggggggcatcgcacataggtgaggcaggggagaaacatgtacaagttaaataataaaatgataaagaaatatcaatgcccttcaattttgtaatgatgcaaaagcaaaacaaaatatgtgaagttgctatgcctacatgtgaatgtaagcaaaaactagtgcatcagaggcagcaacaaaattgatgagtaagttggtatacaaggttcatgaatagtttgacagtaaatcagttaatgatatttctaataatacacctgcaattaatatatttgtgaatatagcatcctcttggttaactgtaagtagagggaaaccattgtgtcaatgggccgcaaagtgaggatcaaacaaaacctgcatcatagttgtcatgaaaattacatgataaaaccaatttggattcaaattcagttaattttggatgttagccttgttagtgttgtcaattaggtatgaccaccattcatgattggacatctgacaatgagtgaattgaagtcaaattttaggagtgaaatattattcatcaaagttcaagtctaagtgctgaaaatctgactaaaccattcatgtaatagagaggaacttagttgaaaagaggaccaaactatttaatttcttgcttgcgatacaaccacaaaagcaggagatgcaacttaggggtattgccctgtacttggatcaggaaatacaaaaaaaaaaagggatagaagacctggtacggtgaacaagatttttcttcaagacatggattatcagccagtaaactaagtcataacacaatcccatgccacacatgattggagaagacatgaaaatattgaaaacattaaatgaaacattcaagaagcggctattttgaaccaattacatcggtctatggtgaattgatcattgacctggatgttcccagttctataaaatccaggcccaaaatctggttccattgcttaagcaagtgagcctagatcatgcgtgattctaagttttctgccatcctgcttatgatcaacaataacagtatcatccatcctctgctctgagatgaataaaaacacaggagtccaagcccagtttgttggaattgtttgctggggctttgaagtgattagcaatgaaatgaacagaattgaacaacacaaggggataacaagctggcctcaaacagtgccctcagactaggacatggataaaaaccatcatggtgtagtatcaatgaaacagttcctatgtagtgttaataaaatcaacaaatgagaaatgaaagttggggggagtagattttttttccatatttgaagcatggtgaccgcaataatgaatgccttaatcaaaggaactaaaatagcaaagcacatccattttgggatttatgctgcagcttctttgctcttctgagtgcagttgttcccgtctgaacataatcaactgcttttgagacctgaggatacccaaatcattgcataatctgtacaagataacctgttaaacattttcaatagcagcaagcaaatagttcgaagggaaggaacaggatgatatgcactttataatagagataagctcactcatatgcatgtgcatgcatgcatacaaaagctctacaaaagcaatattcaattcatatatcatagcattctgttgcagaattgtcaccacacatgcttagaccacaaaggcttacctgacactcaatgttgtctagtatgtctccctgtgcctcaactagtattgccatatccatgaaaacctggaaagaaaataatatttaaaccaaatcattgcatgaataagcttaattatcttgacattgacagaagctacctgatgtaggtcaagtagttttttctcaatctctttgacagcatcatgcctttcttgaatttcttgcacagtgccaatcacctgtagagcatcattatcagttatcagagcactagttaaatctgcatacagtagatgacttcttggaacaggggtgaagacattgggtagtagataaccaacatggtgtaatagacataatgtttgcatattctctatagcatacagtagaaaatggacatacctgccctcgacctactgcctgaattgcgttttgaaagatttgctcactatttccagtctcgatcagatgctcaatcatctatacaggtttgagcagtcactaagcagtgcaatagcggggcataatcgtgatgaaaagtctgcattaggtctaaggctaaccttttcggttggtcgtgttcccgtgactgttcagataacaagatcttgagccataagttcaaggacaaaaatgctaacaaagaatgtaatataaggagaaccacagcatatgagtctatgtgctaagagggagatggaggaaaggttttgaacctgcgaagacccttctttcaacaacctctctgtattcatcttggatagtttgccggagattctgcaaaagacatcaaattatcagaagatgcaatagcgaaggcatagacattgtcgtaaaatggattgagaaataatagctgacatatacctgaaaatcattcattctatcctttaatttccttttcaaggcactgcaaataaaggaaataataataattgaggtgaccaattgtaacagcacaatcttctggcttagttgatttttaatagaaacgatggaaatgccagatagatagcatgtaagactcacagagtcatagccatcctcgagcggtccacacctgttcccttctgacagccaggcttacttcggtttgttaaattctagagaagaagcaagttaggactgctaaaactaaagatatcatccttaaaaaagaagtggcacaaaatacataggatgaataatacatctctgtcaatttcttctaatcttgttctgacgttacgtgcgatttttcccacttcatccacatctttctccatttgctgcttgattgctgcaataaatcaaacattaatttttggccaccatgttgcttgatatttgaggaggaggaccatgatatgacatgaaagtttaataataaaagagaaccgcacctttcatgacagaggctttagtaacatacttagactcttccttagcttcctgttatagtttatcaataattagttaacctcacatgctgtacatgttataattgattgctgcttttgcctttcccttggcattgcgcaacttcatagcataagataggcatatcttacaagaagtcttagtaatctttaagcaatgcagaaaatataagtataagagaggacggaacaaaacaaaatgctctaggcaactcaaccggtcgcattacaagaactaagaaatatttaaaaaaataaaaaaaaaaaatagcaatcttggtacctgaagtttttgaaggtgtttagatagcttttccatcagcttttcaacatgttcaacctaacatcataagaacccaaactatatattgagaagatacaagaaaagacacattctgacgcacaatctaacatctctgtaagtactaattaaaatatgcatggcaaggcaagtggctaaaagcgtgagagaaaggaagacaatagaacatgcaagtgaaaaaaactaactggaaaatgaattaacagtacatttggtaaggtaaacaagaaagaagacatagaacagataatcaagcctggaaagttgaacatataagccaccacatttatatcactttagattcaaaaatatttcttgattccatgttcaaatacgtaatatattgacagaacaagacagagctgagctcgtagtaagagctacctgtttaaaaaaatcttccattccatagtctgatttactttttggaatctgaattcctgattcaatatttctctccttaggagaccgatctaagctcattacaaaagaatcctgcaatggagtgcaccatgaagaacataatattagtgatgaagtagtaggacaaaataagtgcctatgtggtctgaatgagggtaataaagataaaacagaagcctaggagtacatgaattgcaaaatacactactttgcttggacgcccgttgatgtcttgttgacttctaatcatcagtctttacatgactaatggtagggggcacctgtcacatgaaagttgtccccacctataactttgggcatcaggcaattttgaaagtcaacgggaagccatccaactggaaaatgtctttctagttattgaacagatgtacccctgcggcctttggagcaatctgaatcagtttatacttgccattcaggttcttaaggttgagctatatgtcaaataaaaataagaatatcctacatatgaacctctattcagtttaagtgtctaatttatgaccctcgaaatgaaagccatcaacatcttaaattttatggtttgttagactcttcatggtatattttatgaatcacttcgaagtcatccaacaagccaattcagtgtcatctccatagaaaatctctgagcaattgtagttgcactttattataaccatggacaaagtataattttgatgactatgctgcatactcaactcaaaggcatgtaacttagtttcagcaactacaaatcgagcaaaaaggaatctgttgggggatacccaccgaccgaccgaccgactatcggagggcccgaccgactggcggcccgaccgaccgtctccgactggccgatcgaccgactgacgggcataccgaccgattgacggtcggagcgccccgactgaaagccgggagtgcccgactaacggacgctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaaactaaactaaactgttttcttgaagaagttgatttccgtcggtgccaacttgttctgttggtaaaagtgatgcgaaattcatgtatacaagtagcagcatacgtatataaagaagtttaacaagttccaaccccttaaaaccagtgcaaaatccgtgtatacaaataacaaaactcccctaaacaaagaattcttttatattttgataccaactctggaagaagtatcaaaaacaccaaaattttcaagccccacaggaatcagagaaagactatacagtttatatataagattatataatcaaattaaaaaaacaaaagaagaaataaagaactttaggccatgaaaagatcatacatgggaaaaaaattggaacagataaactttacttccgcttgcaactacaaaaaggaaggagattattaccgaaagaaggttgttcatcttgttagtattccacgaggagggggtgctgaaagacgggttcggaggaatagaaacttgagaggggttaatttggaggagtcgaaggaggagagtcgagaagaagttggccggcagaaaagaaattagaggaagagaaagacgacaaaggagtcaattcttggcgttaagaaatacaagcatagctgcatagaagaaatcctacatataaaaatcagaataatagaaaaaggagcttcccacatcccaatcctcggctgttggaaagcaaggatattttcacccttcatttttttttttaaaattaaaaaaaaaaagaaaaaaaaactaaaaaaactcagaacaaacgttcgacatgagttggtatgacgttttttcacgaacaaaacaaacgggttgagacatgaaggctctttgaatactcgtaattacattcatggctttatggcgcccggacgtctgtccgagcatgcatgcaggtgggccccactatttccaggataaaatttgcctaaacaattttttcttttagttttcacgcaagtctccaaaacaacccccggagcatcttaattatgcagaacaacagcttaatgttcctagttctctccttctcaagtccatgcccaagtaattgaaacgggtattgaagcatctggcttagcgggcaatgctgcgatcgctatgtgctcagattgtggtgcattagtcaatgctcaacaggtttttagaggattgatgaaaaggatattgtttcatggaatgctttgatttgggttatggtcaggagagttcctatgagtcagctattgaagttgtttggtggatgtctggccaggacaccacctcccaagaccctttcagtaccacgcgatgcagcaggaagaaagaagaaacaaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaaatcctaacagaagtatatgatcaagtgaagatagcagaaattgagccagatgacttcgcctatggaagactattacctgttcaagggttgcggttcatgccggcatgatccatgcatcagctacttagaatgggttagtcttgagtactgaagtgtgtaaatgcagctgatgggcaccgggaagaagcatcaagtctcagggaacatatgcaaaataaataaataaataaataaaataaataaaataaaataaaaaataaaaggctgcagctgggataattactcaacaacattcagtgtcagcctgggaagtagtacattgcctcagacttttgggctcctttgagacccttggtttcctttgcaactctgatacccttagtatatacaccagcttatacagaaaaaaaaatattcattccagccaaatatctgaatgacatggaagtacgtcaagtgcggtatgtcagtaacacagagacgatatggaagatgattaataattagtatttaactgatgataatgcatactattttcacttcagctgatattctaatgtctttctgggaattgattaacctattgatctccaaaattttagcacaatgacattttactttcatttttgtcatttagttcaaaatagttttgcaagtcatcttttgagcagcctagcaggttattcagatttgcaggatggtggatgttctactgctccatcaaggctgtaacctgtttctttattgtctatgtcaatgaagatgtctctcttcaacaacagctcttcatcactggatcttgatcatttcttggctagaaaagcaagtagtttgctggttgttaggtgctcttatttgtttgctcacatcagctttgttacaatactcaaggttgctatgtcaatccaactgccatacagaacaatgagcttgttaagaaacaaagcatgacagcaccaatcatgaaggctaccaataccttggaaaccaaggaacatgctcataaagacgaataatagtttcagttaaaaagaatcttttattgaataagaaaaatgatcatgaagaagagcaagctgatccgatggttctaagttgaaataacaaaatgaaacccagaatagctgacaggcaaatttcaaacctcaacaaagttaatgtttagaataacatgagacccgaaaaaattggcagatatcagagtctagcacatgccgcacatgattgaccatatcagcaaagggataaaacatacaactccaatgcaaaaatctggtaatatgaacgaggtttgctgcacagtgcattgaagaaaacagcatgaggattgggaaattaagatcatttattagaatatatgtacagaaaattgcatcacaacacaatgtaggttccataaattcacaaagcctatatagtgtccaacatcctggatggaattaagtgccacccaaacctgtctaccagcatcaaatattactagacaaatatgaaggttaatattcacaaaggggtcaagcgcacagcgggctgtatgaatgcttgtccaccacattgttggatcatcctgatactggtgggaaacataaggcacctgtagacctgcttctttcattgccttctcagcaatcacataagcttgaaacagaaggaacgtaaacttccctccttatctttccacgaaatactatcaaggatcttaagttgcacatattggaaggcaaggcaatctcaaaataccaatcagatgctacagctgagagagaaaaaaaattgtaagtcaaaatatatttttgtgtatatgctaaaataagccagatacagttctttcccatttaaaccacaaatatcccacacttgagatttgaccaaaactgttttgcattatacatcagaagccactggatagtggcgcagtatataagtgacagctacattcttgtgaaacaagaaaaaatcagtaattcagacatttcagtgttttacaaaaaaagtaaattgaaatccagaaaattatacaaaaatcatgcagccaaataagcaggatcatccatcgggacgttgaaaccaatggttagatgaatatgaaaccaatggaacaatgtatatagaatgatttcacccatatttccaaatccattcaattcatgcaactccaagatcaagatcaatatgctgtcaatacatcatttctgaactaaatgagcacaaaaattccagatgaaaccattcaacctagagaaaccactattttgatttcagtatcacttacaaatatcaacacaatcgagcagtttgtccacaaaattttgcaaaagcttcgatatcacaagaatccaattataaattctgtctcctggttgcacataattcaaaatgaaaaatttgctgacacaactaggtattaaaataaacatgcagttatcttgggagtacaagtcaaaagagtaagaattattaatatatcatatcatatcatagatgatatactatttagagataaaacaagcatcgaacaaataaacaacattttgataaacagggtaagatgccatcaaattcaagagtagttggtctacaaaagaatatgcattcatagatagctatctgaactctcagtgaaaccatgctattcaacaattcacagagcaatttgactcgcccaaaattctacctaagtaccagctaagtactttaaactaatttaaaagataggaccaaggaagacctctttctacctgcagaagtgtaaaatatcagaatagggtacgaggtgtgttgtatgatgaggaaaaaagagtttccttgttttcatgctaaaatggtgatcgggagaataattcttggttttcatacatgtattaaaggagtgatggttccagctctttgacgcagaaactaggtagatgagcagaagatatatcaggatttatactggaaccagagaaacactgataacaggaggacggagaaggaaagcaggaggattaagatctgaacaaggatatatcacattagcttgcataagcaccacaaaaagaaaagaactggatgataagctttaaaaatggctaatagaaatggaagggaataatacaatgtttgatgtaatttgatgcacaagtagaccaaagcttagagggcaacagctaaaagaactatcctaaagtagaaagaaactggtcagatctgtataattatataacgtctccaaaacactacacgagtccttaatcacaacaactagaaaaattttcaacttgagtaacttttcacagaccaacagattgattaaatctccttcaccaatcatccttgtggacattaaggtcaataactaatgaaacacaaatatctctttctttctcacctgatttatctttagcaagaacctagaaggtaaagataatggaaaaaagagaaattttgcctcttcaatttacaactcataaacatcaaaaattattgcatcatgctttgttcttgagtttttgtcaaattgtacgtgttgcataagctcactcacgcatgcttcacacagttgaatttttcagttctttacagattctccagagctagttagtcctctttgacatcactcaatttagacagcacaaacagtgatgactcaccaaatgtggtagtttgttgcaggacccttccaacttaggtgaagcatcatctcctgttttcaacatctgaacattctaactcttacattacagctattaaggccatatcctaactcttacactacaaaaccaacattaactatgagtatctatagcaaataaccaacttcaagagacaatattttgtatttgcaatcccaaaaattgaatcataattgcaattttattgacaaaatttgtaagattgagtttcacatgagatacataatcccaagtcaaaatgacaaaagttatagaccccaggcacaatgactgatgcataaaattcactcttatatgcatcatttaatctattttgttaatagatcacataagatgtgattgatttgtaaagttcttttatcttatgagtttgagatagtatcagctcatcgcatcttcttttatctatgaccaacacatgtcaaataatttctagcaaatcaatatgaatcattagattatgtaagatcatgcagtgataaatccattgggcattatttttcatatttacattcatggtctgaggctgtagtggacttttggtatcccagtttttattcacaataggatatcagataattggttcagaactttgatctaattttagcaaaaaaaaaaaaaatctgataactgcatcatctaaatattactttgacgtaaaatgttttgatatgtgttgaccatagaaggggaagaaaggaatatgaaaaggcaacaggatctcaactcgttgggtgaaaaccttaacaagtgcagaataagaaccaaacatatataggagatttagagttaacaagtgcgaagcctgaataactgtggcagcaacttgatggccatggaaagtggctgaatatacacagcagaaacagcattgtttttcttcaaaaaaatatattactaattttggaccacaatgtcattatcatacaaaggtacagattcaaatatcttaattaaagactaaacggtgcagcttggaacagattatctttaaggagatttccataaagttattttatggttctagccgatttcaagcactctagtgtcggttgtggttcaaccctgaattgatctcaactccaattccaaaataattggcatatttggtgcaataagattttactctatagtgtaacagaattttttcctggatacatcctgatttgctcataggtactgtacaatcatattagtcaatagctgatctaaacttgggattttccaagcaaaattagaaaggtagaggaaaagatgcaaacttaaaaccaacctacaattatttgtttagggagcaagacaaccactccaatccacatctccgtcacctccacctggtcggccagaaggtatgtactgtatacccagtcttccaattatgcaaatagatcaccttcctgaccgcccagaacaccaccagcattgccgccagcaggaaccccctctgcaccgcctcattcctcatcctcaccaacacatgcgtcgcgaacgccactatcaacccgacgatcgtgtacagaaaccctacggcgaagccctccgcgccgagctgcatcccgaagcccttgacgaagaagatgagccgattcggatctttccgatccttcacgtacatggggatcttgtggatgatgttgtgcataaggccggcgacgccgaggaagtagacggacaccgtgaggcccatccagagccgacggtcgtgaagcatcgttttcccttcgaggatcctcttgatcaagaacggcgcggagatcaggagggcgaccgccaagaaggcgatttgtcgaggggaaatcagggaagggcggacgatagggcccacggggaggctggtcttggcctcgacgaactgggccatggacgcggcgaggccggagaaatccgactggtccatccggtcggagtcgcggagggagcgatgctggggaccgacgtgacggatgtcggggagggatgtgacgccgaagagggagaatgaggactcggattcttggtactcgaggtcgcagaagaagacgcgacgggaggaggcatgatgggcggcgaaggaggaggagacgagggcgaactcggagcggaggcggcggaggtggtggtcgggtttggaggcgccgaagaacacaaggagggagtaggggcgggggaggggggcggaggtgaggaagcgggcgacggagctgtcgtcgaagtggatcacgccggagggggactgggatcggagggtctccagctccgccaccaggtcatcggcggttggggaggcggcggaggagagggagatgagggccgcaacggcgacgaggaggaggaggaggaggacgcgggggatcttgagttccatttgggtcccagttctttggggcccgcggtggattgatacgatctcgcatggacgggtttccgcttatataccgacgcggccgcagcggcaacctctcactggaattttcgaaaaacggatccaatatgacacatttattgaattggacggattcggattttaaacttgatttatttaatttatttaactcatttaattgttagattgtaacgatgtcattacaacatgatctaaaattttatttaatctatttaaaatatatctaacatatttatttgatcaaacttatttattaaattgattatgagagataaatcaaattattatttaataaaaaatagatgaaattttgaatatgcgatcaaattaaattaataagtagggatcaattgatatatatacggctcaaccgtcgttctagctcatcctacccatttgtcactctttgtcaaaaatacatctcttgattttttttatttttttttaaattacaatattaagatatacacacactagaaaaaaaaaatcataatcttccatccattgtaataatattattaattaatttagcaacttgttaatgtatatgaatgagttttgatgttgattgcatgaataatatgtatcaaatatttatcctatattctattctgtattttttcaaggtgatccatctctatagagacaaatggtgtcatttgcgagatggcaagttatatgactaattgtaaggccctattccacgtattaatgttgtatcgaatgtttttttaaattttttaatattttattttttaattcatatggatctatttttaactggattagattaataaattagattttataatatatatatacagagaaagagagagagagagggagagagaatcaaatagaattagactagattttctgttaggctcgtggattaaagtttacttgaatattgtctatatcaacccaacatccttctggagactggtgtgaatatagtgagcgggaaaatagtctccaaggatctattttcttcttaaggtttacaactccaaacacttgacaagcagagacaaaattgcagcacttagaataaggaagttcatgatgaggggtcaggtgtgaggctagtagaatgaaaggggtggccaatagagggagatgaaggtatggatgtcgagaagcgagccacgatggaacatgtggcaaaggaggagggcaacgttgcgacgacagagagtatcatgagtgtggacgagtgagttatggagaaaggctgagacagataaagagggtcacacggggagaagaggaggtgggtgtcagaggaggaagtagttgacatatataggaggtgcagaacttgaagtaggtgaagcgtgaggccggaggggagcttggcatgggcattgtggaggatgggggacgtgtatgaggtttctttttctgcatttcatgtgcaacaataatatgtccaacagtgtgtttaaatttttttctctctttaactaataaattattaatgatctttgtgtgtgtgtgtgtgtgtgtgaaaaagggactcgtggaagggcacacctaggggattcccatcttccttcttttcccccgacctttttttatttttttttctttggtagaattcccttcccctgcacgttcgaaaatacctgaatagggaatactggaatatgcccttgatcaataacaccatactaatgctgttctttctgttgaaaagtgccacttctcttctttttcatgctttcaatcgtgaaaagacacttctttttctatcctttttttttttttttcgagttaaattggacatatttagtttccgtccagccaagtataaagctcgaataagcggttccattccattcatttggaccgtgcaaccaagcaagaccagctaaaacgttagttgtgtttaaatggcacaggagtggcagatattttgcctatcctcgataacaaccaaagtaaagccatcttaacaagatccattctcattcatcttgaacgtagatgagctgaaaatacaattatgccagtccaaaaatatagatggtagttacgtccgctcgataattatcgtgcatttaaaataattataactatgagattatatggtagttgttactatgcagttaagcataataatagccatttttatgcaattattgcatgtcttgcctacgttgatgatggctactctataaacagcgaagaacaaggatccggaaggaagttgtggaatagctcccgctctctttcttaactcactcttttttttattattttttgaattttagccgacttgaacaatagaggatcttctgtcagaaaaattccgacaaaagaattttattttagatttgtctattaatcgaggagttataacagctacaaactcgaattttcaccacatatcagaagaaaaccgacctcattattacatcggccatatcgatcttagcctgattccagagttcagcggtaatgggcatgatttattcagtcaagtttttagcagtttcacgaaaattttaggccccctgtgctggaccagagtccaagaccaacactcaatttttaagaatgaacagaattcaagccatataagggcccaataaaactatacacgcgagcttggcccagctcaacatcaaaacacatgtacagactgagatcaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaatccttatcaatattttatagctatggttaacaactgtttcatgaagcttgatcattccataagttttctgttctttaagctctttaatgtattatatactcactgatcagttaaacatagtttacatataattactaaaatcaatagctacacttttgcaaaatgccaaagatttcacgggctcgattatattacatgagcaatgaggactcgaagtaacaattttttttcagaggcaataggagagctttaggcccacgttttgtcaagcaaatgaaatcaaataaaagagcagaaagggtctaaagtcacaaatctaaacttcgcaactagaaacaatacatgagaagttcaaacttgtacaaataaaactgaggccgtaaaaaattaataaatattcatcgaaaaaataatgaaaaaatcactccaaaagacagcctcataagatactgtcaaccaaaaaaaataccaaaaccaacaagacaaaataagaatgtagaagctccagtatctgtccataggaagaagtccaagtcaggtatctccccatcatcaagaatttattctcgtcttgatgtttttctcctcatattccgagattgaaatcatctgttgctttgggggagctggaagcatgtccggcacgcttgacaacgttccgccatgtacccaagagtttgcaataagactgggggcaggaactggctcaagacgggtagatgattcaactgaagtgaccttaaactgggctgttttattcaaggttgggttatccgctcagcgacccagaaacaggcagccacattgaaacatgcgaggccaattacaacaacgagaaatctctgacctagccatttgacaacaagggctcaaggctcacctggcctaacaagatttcgacagtgagaaaggccagaagataaggccggcttccaacaacgcagacatagcctccgcgaccacaaagactcaaccattctgagatgtgttagtgttgtctctctagtctctatcatatgtagtactgacaaagccaataaaatgatgctacattaatattttaaatttaaaaattctgtaaccatcccaacatattgctgcttaaatattcaatttacctttgtatgttgttatattattttttttattggctttatgtagagcacacatagtagacttagtccactcaagaattttctttttgtaagcacaacatgtatctatggaaaaatttttggatagacttaatctaccacatgtgctttagataaagcttatgaaaagatgctacattagtattttgaatctaaaaattttgtaatcatctcaacacgaaaaattcttggatagactttattctaccatatatgctgtacacaaagccaatgaaaaaatgccacaacctatacaacggtatgttgagtggttaaacaacggtatatatagtgaggtgtttacaaggttaaacaatggtgtgttaagatagttataaaatttttaaatttaaaatattagtatagtatcttttcattagttttgtttacagcacatatagtagaccaagtctgtccaaaaatgtctccatctagtcaagttctatatgtggtggtgaggaatgccaagactcgagtcatggccacgaacgtagatatatgttgaggggttaaatgacggtgtgttgaggtggttacaaagttaaaaaatatattaaggtggttagaaaatttttaaattccaaatactaatatggcattttctcattcactttatctatagcatatgtggtagactaaatacatccaaaaatctctctctcaatacaccactgtttaattttgtaactacctcaacatatcattatttaatcattcaatatattgctatatactatcgtggcatctctacattagctttgtttataacacttggtagattaaatctaactaaaaattttctggctcggtgtctcctttgcctccatggccattagccaccttggcattactcgcttccatagccatgactcactctgcatctccctcacctctggcggccatgagacgaacctagcatcccccgcctctacaggctatgacccaattctacatctctctcgctttcattacctgccacaacttgactcggcatacctcacctctactgctggtcaggatcctactaggtagcgtcccttgcctctgtagtcggcgacatcctaactcagcaacactcgccttcataactaacacctcttatcttcacaactggcttggtcatgtttgagcacacaaaatctctcaatgctcgagctatttgattccttgcatctaagccttgaatgcaacatcctacgaggtgcaggtaattgaatgtgatccttaagttctctagctatgtctgcagatgcaacaaaaaatagtcacacctcttgaagcaagcttcatattgagcctcgaaggattcttgcgaccctcttcctttcttttaataataaataagaacattactaataattaaattataataattatcaatatttcttagtgtaacttatatattaaaatagtgattactatcataatatcatgtggcaatatattatattacaaaatattatgtatttatcttataataatataacataattatagtatgaatatatacaagtatggtaactattataagtggaataagataaaaattatttaatatgttatcaatgataactaaatggattgtcgttatattagaacattcattatgtgtattattatactacaattttgtgttataatataagattatatactatactatattatattatacaatattatataacatgttacaatgttctatagcaatatatactataataaattatcttatctcatattatattatattatatagtatattgttatataataatgttggtagaggtaatcttaccataccaattgcaaggtgaccacaatctattcatgctaaacaactaatgcaagaaccgtaattgtcgtttttcagatgcaagttactcaaaatgatacatgcaaatgcaaatgcagcatttctagttgcaattgtgccgagaaaggcaagcactcaaatagcctctaaacatatactcatactaatctggtgatacatgttgatttttcatcaatttttttattgatttttgaagttgtgaagcaattgacgtcatgataagaagttggattcttctttgcataaaaacggttgacttcaattgccatatttaggaatgctcacttttcctgctacattggtcaatggagataatgacaaaaggtgggaacgttgttcttaaagatagtgagtataagggcctggccattgaccggacctaaggattgcattgcatgaattcaaagcaaaaaattagaactcacatgctggtcacgagattgactgatgaagaaggggacttcccatgggagtcaccttttcttcccaatttccggtggaaaatcgggtcttagggcttgctagattaatctagttaaagctctaggatttcatctataaaaagaaatgggagaaaaggggaaaacaaaaaaaactataatattttttattatctttctccttttgctttctctttctttctttatttttctctcttgatctttcttcgtcattcaacctctatccaaatgtcttgtgcatcagtgaaggatcaaaaaatttagatcaattttgattgattttaggagacattctagtctagtattatttaatcggccccgaaccattatcatgtggccctaggagtgggtttcggatcaatcttgtcatggccatctatcataatccatgaacagttactattttttgatgatgagatctagctctctaggtgaataattattgggacaagaaggcgttaagcggaaacctaactccgagtttgcagatcgagtatctattctacttcatttggttgtaggtagaaaaaaagatctctttacataatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatatatatatatatatatatatatatatatatatatatatatatatatatcatatatgatgattttttattgcctagatgatgatgataatgattattattattattggtagaaccagatgattattattaattgcatgatttattgatgtgaatctataaatctatattctctatggcatacatgtatcacatattgattgctgggaataaatattgattgttttgaaattgagcaaaaactatggcatgaaaattatattttatttgacaagaataaaactgaatgatttgatgatcaggtgaagagaatctggatcagctatgatatggattaccaatcatgggtgggatcgtgacactttgaatggtaagtcatgggcaaatcttggtttactattgtgggccgaaatatgaatagtttgtcttatcatcatgggctcaagcatgattattttatcttctactttaagctgaagagggaatatcttaatttaccaccacatcccgaagcatggataatttaatttgcgaagtatgagcattatatatggtttgccataataggctaaagcatgaatattttggtatgctaccataaactgaagtacagattgtgatttgctagtcacagattgaggcaaatcatggttagtccaaaacttaaaagatgcttattgactgatttggatcctattaacgagacatatatgataagtcatatgaaatcactggtcatatttgtgatgatatatgtatatataataatttgagatatattggatatttgatatgagatttcatgatctatgttttcacttcaatattatttatttactattttttacttatattatcacattaatgtaagtgtgggaatttttattggattataaaactcacaccatatttattttctttttaaatctatggggcatgtgatatgattgttggagttgttgagttgaatttttgatactcgatgaatatttaaaatttgtaaaccttattattcaataataatggatttatttacctagactaatatatttgaattttatcactgacatggttattaagaatttttttgaaaattttgtatattttgtagatcttacataatctttgaagcatcgtcctacggtttacataagcgtatccgacacggatagcaagttcggaatatgatagaggcataacattacaaataaataaataaataaatggataaacaaataagatagacactgaatgcatatttggttacatcaatcaacgattatttggtgctgcgttttgaacagatttatacaccttggccttgcatgcctcagttctatgcgatgggtatagggcgtcgtctcatctcccgtagcatggtactcttctgcttcatcgcctgtgcagcagtcacgatggcctgaggcaaacctccacattccttgataatattccttgccacctcttccagctttggtgattccatcacattccctgcaaccttcttcagcagatcccatgattccttctctgacaaaactcccacttcaatgaccatttggcactccattgccctgcaaacgttgctgctccgagatgtaattataaccttgcagcccttttgttcacctccacatggaattcccacattgctaagatcaaacctgtcccatagatcatccaaaattatgaggatcttgttcatatctttcagtctggctgaaagtgcggctgcaattgccgactcgctctcctcatcaatcttcaatcctaatttctctgccatctcattttgcaatcttttcatgcttagattttgggacgcagtgaccatcaccacctcatcaatgagtccctccccccgtgctcgcattgcagcttcgttaactaaagtcgtcttgccaacacctgcaacgccatatactccaattatgtgaactttatcatctcttagtgcatccagaattctactaatagttgattctgtggatgaatggtcctcagctagttgagtagaaggcaagggaccactaattggaggaggagggctatcctcagctagttgagtagaaggcaagggagcactaattggaggaggtgggctatgtgacaccctttcaaaattcccttcgcttaagagcttcttaattacagccatcttcttttcagcatttttgcctagcttgtagcggaagcacatatccggcaacaatcctctgcagcatttgtcgtccactgagtccaccaatcttctcatatcctgatggacggtatcaaagtttttaagccattgctgcacttcgttattgatgatttctcctctcttagtggctatatccaccttcttttggttatcttctcttcttgcctccaatttttcgagatggtgtttaagattttctatcctttgatggtaacaaagtgcatagctcatatgaagctcgagggaattccatgaagtctttccaaatttcatgatggtagaacagtagtgtggtttcatgtcccctgccaagcaatgaaaatataccgagagtgatgttagaggagaagccgagatttgggacagttaatttggaatacctgatcaaatcccgataatgccttcaggtggtttcttgaaaagaaaagaatgaaactgggtgtggtttgggagagctgtgaggaaggacaaggattgcatataagccagaatcttctaagaaatccatgtcacgcaaagaagcagaaggtaattgtaaccagaagtagaagcaaggtagaaaaacaagcgggcccaaaaaataatctaccgtcaaataagggcaattggtagccatggtagcaattgttagccagaaacatctatacttagttgtagctagcaacccaatgcaatggcgtcataaggaaaaggagggataggtgtcacataatcgatgaattatatttgataattgcaaattatatttgatcactgatgcaatatatgggaccatcaaattttatctgacacctccaatccattgttctgatacttcattgtaacccatccccacctctagtcgagagtctcacacaataatcaatttatatgaatcaatatccaattttgtgattggaatgcaactaaaaaagaggggaaaaaacgaaaagataatctcatttttatggaagaaaaaaaaaaaaaacttaatcaaaataaattgaaaaaaattagataacctaatctcctccatctcataagtaaaataaaatacaataaaaaatgtgattgagatggtaggataagtgggagccggtttagccggtgcaagtaaaatacctttattttttatgttattttatttattcgtagttcggaagtggagccggtagaggcccagcaatcagcatccaaaaggtttgtttttgtgggcccagcgcataaaatgttacgtgccaattgggtgcacgacgtctatcacacgtgtgtccttattttgggccgcaggatcgcagaatctcttcttttattaaagcgaacgccgacctccacgtggtgcagcgacctttcctcccccgagcgctaaacgcactccgtttctcatccatgcacgaattgtatgccattctccacttggagagagagaaagaatgggggatgtccgtcaaagggttggagtgttgttagcgccgccctcctccttttttctggtacagacgcccttctttttcttcgatgctttttttttttttttttggttcccccattgcaggcggaaggttctttttgtggaaacgccatcgaccggcatctcttttgggcagggctctattttttgtgcaaaaaagtgatttattttttcttcatatcattaaccattgaatcatatattacatagtttcaaagtattccgattttttttatccttttttatataaaaaaagatattatgaaattcaacagttgacgttgggaaagaaggaatcattcttacacgtgaaagatacaatctcgacccttcctttttctgaccgtctttgaattgtgtttgaggaacttattgaaatggccatttgcaaataaatttttacaatagtgtcactttctgtatccgaatagatcacgaaaagcatcaggagtcttatccagaaaaaaaagagaaaagcatcggggagaaaaaaatatattcctctagatttatggcaagcatcattaatgaaatggctttttctttgtccataacgaccatcattaggagaggatattgcattatcattttcatgaaatgatttatgatgcttctgttattgcttgtaatgcatacaccaagtcatcactcacccagagaaacaccccattataagtttgaatggcaaaaaaaaaaaaaaagaaaaagaaaagaaaagatactaattatatctgttctacaataaatggctttcactgcatttataccttttaatatgatcaggaagctagatagatttcctctcccccacccctcaccatcaaaaaaagatgattggaagttgctttggagttaagcatggtacattttttacataaagcaaataaaaggtgcaccaataattttccaaaagtgaaggtctactatatagaaggactaggaaacagttgttcccctatcttttacccaatggtgtatggtgaagctttgacactatattacagctccccaatgatcgaaacatgacaacataacatcctcataccacgcttatcagcaccaacataaaagaggagagtggcgtaggaggtagagggagagagatggacaaggtggagatgggcatagaggagcagcatgagatggtggccaaggcctttgtgaaccactactaccacctattcgacaccaatcgcgctgcccttgccactctctaccaccacacctccatgctgtcttttgagggtcagaaatttttgggtgtcgaggacattgggcggaagctcacacaactcccttttgagcagtgcaagcattttatctccaccatcgatagccagctctcaccattcggtggtggcattcttgtgtttgtcagtggtaatctccagctatcgggggaggagcaccagcttaagttcagccaggtaaaattttcagcccttcttttttttttttttctcggagcacggatctctagggtgtagccatcgtagaatgccacatggtcatggataatcactattaaaagatggatgactttgatacatacatatgcatggtgcatattatttaatggtcatctcatctatcttttgataatggctgttcaggaatgcataatatttgtggaccacataccatagaggatccatgtgttttttgtttttttgttttttttggaatgtaagctctttggtttccggtacagattcatatagtttatttgggaaacaacgctgagtcattaaaaagacaaactgggaaagattatgaacccactcaagaaagcatgcgtggccccctcgccatgtaatttccttggggttttcgccatttcttgatgactttccaatttaggaaaaccaactgatcgatttgagccatgacgaggacccttcccaataatttaggaaaatagggtctggtatgggtcttgtgatttttgatctaacctattgtagctcatatatcatccgagtctaatttggatcaatgaaaaatttgtctaatctaatctaggctccatccaatcttgcctaaaaatccagatttttccttctttcatacttttattaaatgaaccttcacccggagtaattctttttgtcttttccatctcaactagcaagatttcttgcatgctcttatttaactatatttaaatatccattattgtatttttagctataaaagggtaactaaatatttaacttgagctccaaactcagcccgtttccaatgtacagtcggacactttaggttgggttttggtcatacttgactatgcacccaaattaatcaacctaaacagcctccttgatctattatcttgttcatgagcctgatgataccaaaacgaaggggtttgtttggagtccaacacccaaaatgaaaacagatcacattgggtcaaccatgccgatgtccaatttgatccatttgcagctctatttttcattaggcatctcacattaaattggaaatcagggtaatactatactaataacgtgcaaaaatcaacaaccattctcgctgacaaaatttgaagagattttgaaatttttgatatttcttggattttatatcaaaaataattaaaaaagactttatgaagcatttattataactttgtctatcaagtaaaaaaaataaaattaacactatcagaataacatattattctaaataatttttatttaaaaaaaatataaatcatactatatttatatgtttcttattttatgtcatgaaatgcatgtcttatagatctagcgctataaccgttgttccaaacatcttagcaaatatgtttgagaaattatatgatttgcaaaaatatatgaagggatttgttactgcgatcgctggaggcatggagtctgtgatttggcaattttctttgatcttgcttgcagatgtttcagttgatccctctgccgcatgggagcttttgcgtgcaaaatgacattttccgccttaactatggttgattgctcatgatcctggaggaacaaacaaatgagacagccagagtggtggtgtgcacaccattttaattgtccagtctcatattttaccaaatggaaccaatcattcatatggcgtacgtggctatcagatttgtttgttatttgatgtttgaaattaacgaagtttggttactttaagatttaatttttctttaatttccgatatcaaagagctttttatctttttattttttttaatacaaatagataatcatatcattctaatataaatataattaaaaaaattaaaaaaataaaatatcctacaaaacctacagaccgcatcttcatttcttcatcaagtcttatatattgaaaaatgatatactgagtttgaattcagcatctcttgaagagacaccgcatgattgttgcactacttcggtatttgaatggatggccaatcatgtaatactagattatataagaaggagaaaacaattgattggcataaaaaaaattcattcacaagtacttcactggatataaataattaccaacaaataaaaatttttgatacttaaacctcggtactgcatatcttcaacttgtgataggcagaactcatgccaatcatgtttaggatattgaagccaaaaaccaggtcagaaattagaccacaaaatcctttccaacttagcatagagaggatcacgaaaacagtccatgcacggactgatcatgtagagaatttttctcgattttattgaaacaaaaatctgatcatacatcagtctacaaaatcctctccaacttaacattgagaggatcatggaaacaacctatgcatggactgatcatgtgaagaattttttttgattttattgaagtcaaaaatcaaatcacaaatcagtccacaaaattctctccaactcagcatagagaggatcacaaaaacaatgaatgtaaggttgataatgtgaaattttttttacttcaatataaaaaattattgagtatacttgatggtccctttattattttttctatctcgatatcagatctcataccaatatccaaccggataccaatagaatacatactcagtgtgatactcaatttagtaggcataccgagccgtaataaactattggtgggatatggtattgccacataacgggcgttgccatatccgtgacagaaaatcatgctgccgattgcaacaactcgtaagacactcttgaagcaactactaacgctaagttctgcctctcaaagatttacttgccgcataagaacacggggaaaatgttggaccacatatttgttatctgtgtcccatgtaaagcatagttttagaaacgaaataaaagcagaaccgcagaattaataatcaagctcctgatagcctgcatggtacaggcatacatgcttgtatcccaacaacaaagaaacaagatcgtaggcctcctctcgcctctgtagtttgtttccttttctgttacgcccgctgtattgtttcttacttcaatccaatcaccaaaaacaaaaaagaaacaagatcgtaacctcggtatttctagataattgcatcatttaatttagaatctttgagaataccacaatttggcttggaagccctcttgcttacaaaaagttttatgtcaagcaaataagggcagaaaagaacagagaaaaattacactaggaagaaaggctccatcataacttccagccatgcctgcaagcctcatgaccatacacaagcagtccagcagcccatctacgaacaaattaaatcaaacaaaaggcatatatgaacagttcacatgattataaatgaagaataacacttatgaaataaagatgtaatcatatatattttccctagtacatatacaagctacggggtatagaaagaaagcattacgcacatgaagtccgtgggttccatatgatgccggcaatcaccgtaagctgtgaaatgtacacgcctcaagtagttgataaaaagtaaaataaaggttctacgagcataaatatactgaaagggatccatgtcagaaattttataagttggtcttcgtggttatgcaatatctcatacagaatgtcgcttgaataagctatttatgatgaactttccttgaaagaagctcttggggatgaataaatgttcctagcttaaaatcagtatgtcagccacatcaaacatttcagctgggctgtccttttttttttttgaaggaaaaggagggatcaagtggcttccccctatttatttattgggcaaacaagagaagtgcaagagtttacttaatgaggcatatagagttacaaaatgttgtgagctagaagggtgatgcaccagcaatgctaggctattccatacagcttgccatggctttcacaacttcttagtatacagtggttccaaagaatgaaatgcatatagcgctttttggaatacataggcaatgctttttcctgacatatcattttgctgttgaaaaaattctcattaattaagtggtaagaccaaacaacaaagcttttattaattacccgaccacctcttgatcaacattacagtctatgaattttactactgaaaatcaaaaatcttaggatacattgagtttgtgattagaatcaaaatcgaaattggagtggattgtaatagaaattgaaatgattatatcctctgatatgtttcatagctgatcaaaattagaatcagaatgaaattttaatcttaagatagagtagagattagattttgagattggagtttttttttttttctcactagagacggagttattcatttccgttctttttgcaggtccaattttctccaactaaatatgtccttacttatttaatattataatgccaagagagccagctttttttattgaaaaggagcctaaacatcacaaatacagtaaatacagtcataattaatttattctaattgacaaagatatatatatatattttcataataaaacaacataaatcaccaaaaaaaagaacaagaacagtcagtcgggggagaagccctactcaaaatccaaagtagagaaaataacactagataaggaaacgacacgctttggagttggaggtcgatatcgaacgagggccaacgaagttccctaatttgagcgaggcgagtggaatgcgaagtgagaggaaaaagatgggaggcgcacttgtaactccactgacattgtgttagacatggcaaccacttgcggatttggatttccccgcgtgccgggttggatgggggcttgtcggagtcgttgggatccaaagggaccacccaatcgtcatcgaaagaaaaatgtttagatagcgatgttattatgggaatgaacgagatccatccaaatctttgacaagattcagcatattcctatcatcattataatgtcaacgatgtccttgtcaaaatccactgaaattttttttttttttttgggtaaagcactgagactatttagtggacgtttgcaagggtcttcttgacgtggttttgatgaatcttgatgagatttttatatgtctatgttgattttcgtgaataggatggacacaaactatggtcagtttgagtccagtccaaacccaatcggaagtcagtattattaagcctacgggggctgctagatggaaaaaaattttctctcaaatttaaatttgaataggttcagaccgccaaatagggtccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtctattctcattgtacaaaaaatcatataagacgggcaccaataagaaaatatgggcgggcttcctatttcgccacatgtcctatagtacctgtaataactcagaattaagaaaaaaaaaaaatagaggaggaggaagactcctagccgaagtcttctttcttctcgtttccggcaaaatcggactcaaagagtccggctagggtaggaaacccccactataaagatccccccatcctctcttaggaatttacaacaaaattttgaagtaaatcgagggatttgagagatttttttcaagatatatcacgatggttgatcgaaaaaaaaaaaggggtcgccggagctgtttttggccgtcggaacaaggtatgttccttcttcctccctttcggtttagtctctccagccatggggtacttggaagccggcgaggtgccggttcgggcttaaacagggacacccctgtttacgttttatttttttcttctctccgtgtgccgccggcaacagccaccgttggggctgtcaccggggctgtggatgcatcgccgttggcggctgtcggagggtggccggagtcggccctccttggttgcttgagggtgagaggagatggaggggcacgatgccctgttttgccccaaaggaaaccacgggaaaagaaggaagaagaagaagaaaagaaaagaaaagaaaaaggaaaaagaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcatcacgtatccgacccgggtgttagattcggggtgtgacagtaccatcttaaaaaaaatagtagtccaaagatatgaagttcttcggccaatggagtcgttggtcctgtgactaaataaaaaaaaaaatcatgctgcttttttcctcattaaatctctccatatacaatcgatttatttatatagcacaggaatggttactgggatgctcaagcgggcacaattaaggaatggtcaatactcttttgcttctgaaatcactaaaacaagataaaatattagtgatacaaaaaatttattattaataattaaattttattgttaataattgttaacgataaaattatcatcattaatattttattataaataatatcatcgttgataatttttttacaacgaaaaaaaatttttcgtctctaataatcaatattatcggcaaaaaattttcatcgttaaaatttttttttcaaaaattatttatgataaaaaattttaatcgtaaaaaaagataatttgtgacaaattattacattactaataaaaaataattatttacgacgaataatattcatcattattaagttaattaaaaatttttatgaaaatcaattatttttctcgctaataattttttatgaaaattaattattttattaagttaatcaatttttatgataatttttgatgtaaatttttgttgttaataaattatcaattatttatgaagaaaatattttcatcattattaatttaattaaatttttttataaaattaaattaaaaaaaatattagcgatgtaaactttttattataaatatatcaatttctgacgtaaatttttgttgctaataaattatctattatttatgataaaaatattttcatcgttattaatttaatataaaattttaatatttataaatttattaaaaattttatttacgatcaatttttcatcgctaatatgttttttgtgactaatattttatcaaaaaatatttcatcgctaaaagtttacacaaaatttttttttaaaaaaaanaatttatgaatatatatatttaatttatatttataatatttttataaatttaaaaataaaaaataaagataaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaggagaacggactggggaaggagagcgctcgaaagaactttgatcggcctgctgctgccttatcagctgtgctatccgttccatttgtactatccactctatcatctggatctggagccgctgatattcgtcgatacgtgcagttaacttatcagctcgctgctcaatcggcctctgcaccttcgccagtcgagtatcgcaagcagtatggatgtcagccctagacaagcgtgaggatgacggagcactgattccatgttctagatccctaacataataggatctcgtaccaagcacctgatcacagatctcgtcatctgtcgatacggtcgagccctcagaggtaggctgggatctgatgcctatcatacgatcctgaaaattaaagttatagctattttaatttcgtactgaaaatcaaactacaaatgaaaaaaataattaaaaaaatttataaaaaactcctggctccccatcgtccactctcctgaccgtcactggtgggtccgttagtagatatcgatcctaccagaaagctcaccactttttgcatctctctgtaatttgagaataattaattaaatttttttaaatagttagagagctaaaatatactaattagaaattacttaccatctgctccatatgacgagcgaacgacctcaaaccctcacaatacgatacggtctatctcatccgattcgcggcattctgggcatatcgtttctgtacagttagcagtcaaattagtatgtaacaaattaaatttaagaataaatgattcaatcattaaattctaaaaaaaaagaagtttgtgtgtaacctgatatgctagatcgtcataatgtcggcatatgagagtccaatcatccatagtgatgctgtcatagggtcgctattgcgctgcctccaccccatgatcctgcatcacctggtaccaatgctgatggatgtggtggcgatactccttgaaatgtaaatataaatgagcatccacagctcgccgcatgcgatccttctcaaatccaataatatcaaatacatcatgtcaataacaaatattaaaagaatatcatgctaattaaatattcataatataatctattttatctgtaattgagtatagaaaatctctctttgagcctgtacaacatgacgccaatcgaaaagcatcacggtggcatagctgcggcatatgatgcccagctcggtctgccacgactcacacaattttttaatgggtctggtgtagtcaggcggtatctcaatacggagatgttgtcttgggtgctcgcatctccaacgttctagagcaaggttcttcgatggacctcaccctcgcctcaccattgatagagactgatgtgaaacaacaataaataaattattagtataatagctatctaaataaaaaattaaattttattatataaaaagtataataatatcacttggatccgtctcactcggacctgtctcattgggatttgctagtgcaggaccctctggtgatggagctagtacgacagtggaaatcggtgaagatgcctcagccttcggggtagactacgaacgtgaacgtcatcatcagtctcctgatgctatacctataatttttgatatataaatgaatataatattgaataataataacggacaacaaattacattctaatgaatagaattatatcgcattccattattgtaagagaagattgaacaaagaatatagatctgctcatcaatattcgtatcttcctcgatatgtaggtcctccttcgaatcacaattatcgacatatgtatcgtcttctatttcatcatcatttatgaattgatcgtcgccctctgactcatcaagattaaatacaaaattagcttcaacttcgttggacggtagatcaaccttattcaaaggagctgttacaagttctttatcaacaagaagctcggctaatgtttgttcttcctcttgaaaagcttcctctttatgtaaatctaaattttcacctatctctaattgggttggtatgtcataaacatctctagatgttattttttgtacgacatgtcaattacctcgatactttagattcttcaaatatattacttgtttcgcttaagttacaatatatacgactcattttggtaccatgttcgtgcaaagtttacactaataaagtgtagatcgatatgaatatcgatctttttattactaatatccaaccattcatactgaaacaagaatacagaattactggacccatacttcagttctatgatactatcagtacatcataatattcaatctcttcttctctttcatatcctatcgtagcaatcccactattctgggtccgtcattgcatctcaaactcctttgtgtgaaatctcattcctccaatgatataggatgcgtagtggttaacccttcgatcgggaccacatactaaattgtacaactcatcgatcacatcttcttctttattgaaatacttatatttcatctacatcataacataaaaagttatgttggttcaaataattatnnnnnnnnnnnnnnnnnnnnttctacaattattaaaaataacgtattactagtgcaacttacaaggtcaccaaatcattttgtaaattttctcctatattgatcatcaacatctgtattattctctctgcatagtatactcttgtgctcactgtaataagtcatgatttttaattttacatcaacatgaaaaaattacttagaatattaaataatatgctaagatggtacttactcaatgaaatctttaatttcttcataattatttaaaatgtagaagtatgccttggatagctcattcacatccataaattcatatctcttttcatcaatggatcgaactgtttgtttaaatataaacagcatcggttcattgtcatcccattcatggtctgcgttacgatctgtacgattgaatcttatttcgatattgtcaagatatatcgagcagaatgtaacatacttcatagctacatatgcttccgttatagatccttccgatagtactttattgtgcacatacttttttagggtacacaagaatctgcacatattttgttgcgctaccaccctttccaatcccccgtgatccggatctcaactcggatcctgatcgaatcctgatttggatcccaatttgaatcgggatctcgacccgaattccgaccttgatccaattcagatcgtgatccatattttatttttattaatcacataataaaatatttgattaatattttattttttactttttttttccccatcatttctctcttcccttcccccctctccgccgtcacccacccctccccggctgaccccatccccgacctaccctacggtttccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaaaaaatatttcacccaaaaataaattattgatgatgaaaaaaaatttcatcattaataattttattagcaatggaaatatgatttccatcgctaataaataccgtcaaaaaatttttttttctctaacaattttttcttcaaaaaaattaaaaaaaatatttttaaaataatttttttgatgaaaacacttttttatcgctaataatttttttaattaacaaattttttgttcataaaaattggttaaaataatatttttaaaacatgattaccgatgaaaaatatatttacgtcttaaatatattttcttaaaaaatttgataaaaaaatttaaagactatttgggataaaaatttattttatgttactaataattaaatatcttttcaataataatttcataaaaaaattaattttggatcttttctatcaaaaaaaatttccatccaaaaaatttaacaaaaaaaatgacattaaaaaatagtcatgatgaaaaataaaattaatttttttaattttaaaaaattttggtctaaattttttttaaaaaataatttagttaaaaaaattaattttcatgcatgtaaagattgagcttgagaaattcatcaaaaattatgtgaacatcaaagatctagcaattaaccagaatcaaagcagatctgcaaataatgcaagttgtgttataaagcacaagctcatatttatactttgcattgctaggaagatgagtgttcgtattatttatcttttcatgattgaaacttctacggagatacatttgagcgttgatcgatgcgaaaagtacgatacctttcgagatcgtggaagccatgctaaaatgtgctgcttcattatatgatttttgcatgaaaggaggcttatttcatttagtttaagacagacactccatcagaaagattcattgatatcactagtaatagtgacagtgatgaacagataaattttacatcgcaaataaatatatagcttatttcatttaaaaggatctattcattctaatctgtgaatatcatctatttttatatgattttttcatataaaaagttcgatttggatcataactcacatttgcttctttaccatgtataaagataaaaaatatatacagctgctaaaaaaaataggtgcagttaccttatacaaaatcaaaattttaaattttatgatttttttaaagttttaatttttgtacatattggcgatgaaaatattttcatcataaataattgtatttatgatgaaaataaaaatttcatcataaataatcattatttacgatagaaaatttcatcgcaaataataatcaatttttaattttttttaatttctgattttttttaactattgacgatgaaagtatttttatcgaaaataattatatatttatgatgaaaatttttttcatcgcaaaaaatttttatttacgatgaaaacttttcatagcaaatgattagtaatttttatttttttaaaattttttatttttttaattatttacgatgaaaaaattttcatcataaataatcaagtatttatgataaaaattttttgtcatcataaaaaaaaatgcttatttacgatgaaaaatttttaccataaataatgagtaatttttaattttttttaattttaatttttttaactatttacgataaaaaaattttatcataaataatgagtatttatgatgaattttttttcatcgtaaatattcaattatttacgatgcaatatttttatcacaaataatctaaaatttttaaatttttattttttttcaaattttgacaatgaaaatattttcgttgggaataatattattgcagatgaaaaaactttttccgatatacatacttaaattatttactatgaaaatattttcatcgcgaatatttaaaaatttaaaattaaaataaatgatatattatttacgataaaaatatttatcgcaaatagttcgtatttatgacggaataattttttcatcgctaatatgtgactatttgcgatgaaaattattttcatcataaatattttattatttatgataaattttattttttattataaatattattaataatgataaaaatatttatattataaataattttatcataaaaatattcttttctcgctgtaaatatggtttcagagttcaatatgggtctgactccataaaagggacgcccgttggataaagtaaacttggtagatgcaattacagaaataaggcgacttgtaaggaactttgactcctacaatgctatgcaccgatttcttgaaatatatttttttggatatgatttcgaggttttgcactgtatcgtggtcatccaaaatagtatagggtcagttcaatctcagctattccacacaactgttataatagtggtcactcaattgtgaccactctataaataattccttaataaatgtcttgggtggtgtaatccttctatttaactttaaaaaaaaatctcttcatatatattagattgttatatatttaatttactaaatatgtactatttaattatatattggacatcatgaactatatattgatttatctaaatggacgtattaacttactagataaccgtcatgagaagaaagtacttttaatctcatattgattgttgtgagtcttgaaatgatcaagattcactatagatatcaactcggttcactgtagctagaagatctactgatctgaaacagccagagttgaagcggataatatctcatacatgcgggagtgaagactgatacaatcatccgaatcattcaatccttgatgacaataataattaatttgcttagtatgtatcacctaattatatagtggatatcagtaaaaaaaagatatattttggaaacaagaaataaagaggttttttttttaattatgggattggtgactttattagtagaagtttttagtttttagacttctgtttaaagataaaaattagagaaaatgtgataaaataggaagcttatctcatgttttcttagctgatgcccaccacgtatgaaatttgttgcaaaatttcagaagacatatcctgagaaaacaaaaagagagaatgctcggagacaattattccaaggatttaaaaaagagagagcaaatgagcgggtataatcgatgcccatttgccactaatagttatgtcgttttccttgcaaggttgcaccaactatatagttagcattagtggtgaaaggaatctgatctcagtttcccattcacaaagacgagtatctcaggccgaaggacatcatacttgaccgtaaacgagtattattccattttcccaaaacacaaaagcaaattgggtatcagagaaattctttgtgcaccgatgcagaaaatatgacatagtgcaccacttcactctattaaatattatttttaaatatatatttaatatttataattttattttttatataaaattttaaataataaaatactcctctatttttgataaaattatgacattcaagataaaaattataatatttttaatcaaaattatgacatcatatcataggatgtcatatttttgatccaaaatattataattttaatcttaaatgtcataggatgtcgtaattttgatctaaaatatcataatttttatcttggatgtcataattttatgaaaatagagagacatttttgtcattcaaaattttaaaaaaatgataattttattggatgaaaatgcctctttgttgtcataaaattataacatccaacgcaaaaattatgaaggtgaaaattataatatcctatcataggatgtcataattttgacccacaatgtcataatttttatcttagatatcataattttattaacataaaaaaatatttttatcatttaaaattttagatgaaaaaataaaattattgatattaaataaatattaaatatatattaaaaaataataattatgcggtctaatagaatgaagtgatgcacttcatataagattttgcggtgcacaaacaatttctcttgggtgttatcccctcccatcttctgcctatagatacggcccacaagaggcttacctgtgctaaatcagaaacttacccaaccaacaaaccatggcactgacccttgaacccctcctcccatctccccctaagaagaccggccttccatgcaaagtactactgaatatactttcggtagccactgtcatttgcttcactgccttcgtcaccatccatctcaatgccagcacccaacaatccaaccccttccagccagctgatctgtgcacccaatcccccaaccccacctcctgcaacaccatcgtcgctgatgccgtcctcgctgctggaaatctctggccacgcccagtgcaggtcttccgcaccatcctccacaaatccctccaacaactagacaccgcctccgccgccgccgccgaacgaaaggagcagccaggcctcgccgactgcatccaactgatggacctctcccacgaccgcatcctcagctcggcctaggtcgtcgctgagggagtccacgccgatgcccggacgtggatgagtgccgtgctcaccaaccacggcacgtgcctcgaagggctcgacggggaggccaagtgggcactggaaccccctctccaggcccttaaggcccttgcgagcacctccctcgccgttctcaatgccatttcccactcctccgacgttgacgatgtcggcaagccagtcgtcaggttcccgtcatgggtatcacaccacgaccggaagcttcttgaagcttctactgcgaatggcatcaaagttgatgttgtggtggccaaggacgggagtgggaagtataagacggtgcaggaggcggtgaactcggcgccaggcaaaagcacaggccgctacgtcatatatgtgaggaaaggtgtgtacaaggagaatgtggagatagggaagaagaaaattaacgtgatggtcgtcggcgatggcatggacgccaccaccattactggcagccttaacgtggttgatggggccaccaccttctcgtccgccactttaggtaaagcaacctccactaaaactttactcccgttacaaaatgtaagttaatttacattaaaatatagaaaaataatttgctatatttcccaatttggcgtgggaaggacttcggtcacacggttgcagttggacaggatgacctatttggaaatgcttggctacccagaaagatgatagaagagaaggctagctaaaaatatatgatagattttgcttatagaaaataatattataacaatctactatatatggtcaaattcaagttacattattggttatatatatatatatatatatatattagatgatgagagtttcatatcaattatttggtcgagctattaaatatgatctgctatttctaaactacttaaataataaaaattatataatttgaagatatccaatatatacttcaaatggttgataattataaaatataaataatatgaaataatttatcatttttgattacttggtacattagttagatgtctacaaatcatgtactttttagtatataaaaaagatagatcacatcgaataattcatatcattaatgtaaaatacctatcattcaattgaaaaaggatataattatacaaaagttatattagatataacttgcccatgaccttatatatacatttaaaaaaaatcttgaccccatatctattatttgcaaaccaagtaaaattatattttttcactacgccgataatggtacaaataaataatgccatcagttcattattattcattaatttctgtcccatatcatgggcaatgatgaacctcaataacccactaataaatatcccctgctagaatgctgaattcatgtgatttcacggggcaatactaatgctgcatgtgcatctaaatcaaggttatagcagccttctaaatgacatatacaccattttttttaaaaaaaaatcattctctgcgcaagtctacctgcgctaatgtgcatcaaaagttcaaaacatgcaatcaaaccgcacaagacagtgaagaaagacctcataggatttggagagaaaattataagatccaaccaaagacagcttgactgacttcaaattcttcatggatctaacctatacatcggtggtcatagcttcatacaaccattccattaaactcttctttcggttcagagcctcacactgcaattatatatatcatctgtttgccgtaatgcagccgcggtcggtgatgggctcatcctgcaagacctcaagatcgagaacaccgccgggccccagaagcaccaggcggtggccctccgcgtcggggccgaccggtccgtcatcaaccgttgccgcctcgacggctatcaggacaccctctacgcccactccctccgccaattctaccgcgacagcaccatatcgggcaccgtcgacttcatcttcggtaatgccgcagtcgtattccagaactccaagctcatcgcccgcaagcccatggacaagcaacagaatctggtcaccgcccaaggacgcgaggacccgaaccagaacaccggcacctcgatccagaactgccaagtggtacctgcaccggacctcgctccggtgagggggtccttcccatcgtacctcgggcggccatggaaggagtactcgaggacggttttcatgcagtcatacatcgacagtcacattcatcccaagggctggtcggagtggaatgggggctttgcactgaagacattgttctatggggagtatcagaaccgggggccaggtgctgggaccggtgggcgggtgaaatggccgggatatcatgttatcactgatccaaaagtggccaagaacttcacggtggccgagctgatacagggagggtcttggttgaaggaaactggagtcgccttcagagaagggttgtgaggtggcgaggttgggatgcagtagcttaattttgctatcagtctgtttggatctctgaatgttttcagtaatttcgcctgattcttccaatggagtccagttgagatgtcaatgtgctggcttcagaggttccttgtgcttattgtggtaatataatcccagcgaccgggattctaggttggcttctgcaatggctttttggtcacgaggataaagctaataagctattttgactctttatgtatctagcatcgagattcgtagggtacaattttgattactctacacagaaaagtacaatttaatatataagtcgagagtataagaaatcttatattctcgacttatatgtacatctggatcatggaagcagcatcttctcatcaaaccgcagcttgtgtccctaacattttatcaaagatcttttagtgcatggaacaagtccatagtctcatgatggcaagttccacaattgcactgaaaagcgaccgaataacatcagtagagttgctaccaggcaggatgctgattttcatggtgcccgacacatgtacagaggcaccacagaattgcaaagttctaaaaggaggctaggacagatgtggtgcttcttaaaagctttcacaaagccgttaatgcgccaaacaactttgtgaatattgatctcaaatattgacacaaggaatcaacatgatgtcatgctggcactaaactttttaggatattgtggataagaaaatgccaagcaattatgacagctacaatagtagccaacaaggccgattcattaggactcgtttggttgacgaaaagtagaaaggagaaaagacacttgttgaaaaatgaaaaaaaagtctcttgtttggttaaagttttaagaggaaagagaatgaaaaaagtacttttcatgaaaaatcacttctcacatttcatgaaaagtagaaattcataaaggaggtaggttttggcacttcggtgatatgagaagtgttggtactttttctttcctgaaataccctttcaagatccatagctaaaatttagtaaaatatcaacggatggttagaatgaaataccgaataataatataatattatattaatattatcttaatatttatataaatataatattaatctttattatattttaatattattttaatattattttaatattattttaatatttatattaatataatatttttattaatattaatataatatttatattaatataatataatatttatatctatattaataaatttattatattaaaatatttatattatattaatataatattaatatattaatattatattgataaaataaattattatggtctaatgttatattataatatattaatgctatatttatattaatataaatataatatttatatttatataaagtttataagtaaaaatgtatagttttatatctgccaaggatataataggtattttacacagttttcttaagaaaatatgtgttcattcaaacataaattactttataataaatcaccttctcatgctcaatcaaacatatcaaaattctattctcaggaagcaactttctgaaaaattacttttcagaaagttgctttctgggaaaaaaaattcttcctacgaaccaaacgagtccctagttaaacccagaagaagcaaagtgcagctttggttggatcgagaggatcatttattgagaatccaactacctatcttaatttagattaccttctagttattctttgctttttgcttttttattctagtttagatttaaacccttccatttaaaaatattttctaattattttcttatccaaaaattattgcagaaacaaaatatttatcttttcaattcgaagaagtttcaattctaatgcggggcaagaagaggccttgttcaaatcttgtttggtttatactagcagtttgcaccttgttgggatataccgaccgaccccttttacgccgactcaatctcgagcttgtccgatcgatgcccgactctaccgaccgcaccgatcaacgactaccgacagtagctgccgatattattcgaccaaagatgtgtcgatcgggcagacccattctgtttccgactagccgagcggcggaggtagattaccgactcactgtcggacggaggtggcagccgacgtccgactcccgcaatgcgtcagaccagccgacggtgtccccgggtcttcacccgatgtcccacagtcgaataccaacgtatggtcggttagctcccccaaacgctgtacgactgctatgggctgctgtcctgacaaggacatgcgacgtggccaccctggaggcatcgtcctgccaaggacataggtcagccccagtgatttgacagtccacgacgacttgtcagtccgcggtgactctgatagcctccaatgatttgacaactctctggttgtctgcgccattaatggtgggaccacaccgcactctactataaaatggggaaggcaacagtgttggtggaggaggaggtttttctaagctcctgagctctctctctctctccctagctctctcctgctgagcccctgattcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngataatgaaagtttgactaatattttgttctactcgaccttctcccgaatgcgactgacggctgatcggctcaagagagtctctacacccctagcagattttgctggagatgctgtcgcggtggaaagagaaattactctttccttgatagctgtaatcgaaccacgataaagcaccatccatctaacctttgcggtcgtccaggtatcttcggtctacaacgtcatacttggaagacccggactaaacgccctcagagcgatagtctcgacataccacctgttggttcgattcccgatcaaaaatgaggtggagagatgcgcggggatcaacagctcgcttggcgatgctttcaaatctctgctcgaagcaacgaatcgaaggactctctgacggtcgacaagttagaccaatgaggagaggaagaacggggcgaaccggtcgaacagctggttttcatcccaatagcagagaatcccaaacgagtggtctgggtcggatctcaattatccgaccctaagcaacggcagctaataaagctgttgaaggccaatgccgacgtattcgcttggtcggcagcggatatgtccggcatcccctcggagacgatgactcaccgactcaacatcgaccctggaatgaggccggtgaggcagaagaagcgatcttttgctcccgaaagacagaaggccatcgacaaggaagtggacaagctactcgagatggacttcatcagagaaaccacgtaccctgactagctcgccaatgttatcatggtgaaaaaagccaacgggaggtggaggatctgcatcgactataccgatctgaatcgtgcctgtctgaaggatagctttccactttcgaaaatcgaccagctagtagacgcgacgtccggccatcgactgctcagcttcatggatgcctttatcggatacaatctgatccggatggcatccgaagatgaggagcatacagccttcgtgaccgctaaggacctttattgctacagagtaatgcccttcggactgaaaaatatcggagccacctactagcgactcatcaataaggtcttcgaagatcaaatcggatgcaacatggaggtgtacgtggacgacatgctggtgaagagtgcgcagacttcagatcatgtccaagatcttgaaaaaacttttcacactcttcgacgacaccggatgaggctgaatccgactaagtgcgccttcggggtgacttcagggaagttcctcgggttcctcatttctcaatgaggaattgaggccaaccccgagaagataaaggtgatcatcgacatgcgatattcggacatcaaaaaagaggtacagcagcttaacggaaggatcatcgcgctcagccgattcatctcttggtcggctgagagatgcctcctgttcttcaaaaccctgaggcaggcgaaggacttctcttggccggacgagtgccgacgggccttcgaggatctaaagagatatctggcctctccgtcgctacttataaagtcagaagttggagaaatgttgtacctctacttggcaacctccccagaggtggttagctcggtgctcgtctggaagaacgagagccgaattcaccagcccatatactacaccagcaaagtgctccatgaagctgaagctcgatattcaaaggcggagaaaatgatattcaccttgatcatgtctgcacaacgactccgtccgtatttccaagtgcacgctatcgtggtcctcaccgaccagcccctgaaggcgatcttgcatcgccccgacatatcaggacgactggcgaaatggacagtgaagctgagtgagttcgacattcagtaccgatcgtgatctgctttaaaagcttaggttttggctgactttattgcggagtgcccgacaaccgatcaagaatcggaagtcgggagctctaaagaggctgcaacctctgaacgtgatactgggtctacctgggtattgcacatcgacggagcttccaatgctcgtgggagcggggccaagttcctgctcaccaactcagagggagtggttaccgagtacgtccnnnnnnnnnnnnnnnnnnnngacagcctcagagtcttcttcgactcccagctgatcgtgggataagtcaaaggtgaattcgaggcccgggacccgaccatggcaaaatatttttagaaggtgagagatctcatggcacaccttaagtattttgagatcttccatattctcaggttggagaacgctcgggccgacacactctccaggcttgcgacatcagcctacgaaactttagaccggacacttgtggagagtcttgagcaatcgagcatcgacaggaccgaggaggtgctgcaactggtgactgagccgaactggatggatccgatcattcgatatctgaccgacggaaccagccctgaagaccccgcggaagccaaacgactccggtggacggcctcccaatacgtaatgatggacagccgactgtacaaaaggtcgttctcccttcccttgctgaggtgcctgagaccgactgacgcggactacgcacttagagaggtgcatgaagggatctgcagaaatcacttgaggggcaaatccttggcctacaaggtcctacggcagggttactactggcccaccatgaaaaaggatgcggctgagttagttcgaaggtgtgagccatgtcagaggtacgctaacatacaacaccaacccgccaactagatcactcccattgtcgccccgtggcccttcgcccagtggggaattgacatactcgatctttttcctccgatgtctggccaaagaaagttcatagtcattgcaatcgactacttcactaagtgggtggaagtcgaatctttggtgcaaatcaccgagcgaaagatggaagacttcgtccagaagtccatcatcttcagattcggactaccgcacactattatcatcgataatggatgacaattcaacaatcgagactttcgaaagttctgtgcgagatttcatatcgtgcataggctgacctcggtcggacatccacagtccaacggtgaggtcgaagtaaccaaccgaaccattctgcatggactgaagactcgactaaatgaagccaaaggcctctgggttgaggaattgaattctatcctgtgggcgtatcgaacgacaccccatgtcccgatcggagaatctcttttcagcttggcctatgggacggaggcgatgatctcactcgagatcggactaccattgactagagttgtgcagtactgcgagccgggcaactccaagtgtcggagagccgacttggacctcctatccgaactccgacatgaggctcaactccgcatggcttcctactgacaaagagtggcccgatactataatgctaaggttaagccgaagtttttcagatctggagacctggtcttaaggaaggcagaagttttgaagcctctggatcaaaaaaaattatccccaaactgggaaggaccctacaagatagtgggcacctacaggccgggagcctaccgactggagactctagaaggaatggccattctccagacttggaatgctgacaacctgagattgtactaccagtgaactctgtgtgcccttgttcggaatacaaacttagtttcaaaactctggagtctagaatctcggctctccaattgtgggtcggcgctcaccagcagtacgagctccgacgctccgacttgggcccaacgttccgttgggaatctgcgatccagtcgccgatgatgcgtcggtctcttacgagaaccgatatatctacgttggtggaaggccggcgatggcgataaaacccccctaagttgaagccaagctccttccatagtcaactctcgagcaagacgactggctaacttgccgaattgactccgaccaagaaaggcaaaatgccaacgcgaccaacgtcacatttgcaacataccgaccaggtcacgattggtcgaagggtattcggcttgccaccgtttatcacacgtcgcgacgtacacgcccgacaaagaatcgggcaatggatgaccgacttgtcatcgttatcttaaccgaatgcatcggacactattcgattatcagactctatgggatgatcgggtcaaagagctacgcccaaaggtcggtcgacacccgactcgacaaacacgtccgactcaggtctgggcaacggatgctcgacttagactctcgactgtcggatcgtacgacagtcaggatgctgatctataatcggagctcgctctgtctttatcgtggtgcgtgctaccgactatcttgactaactacccgggatcttaccgaatattctaacaaggtacgtcgggcctatgacttatatgctcgggggcgtttcgacgaaacatacattccaagatacatttcaggatgcataaagaaaaaaaaaggttgaaaagttctcaatttcattcaagtataaactgaatttataaaattgggccgaagtccgattacaagtacactaagtaagagcaaaaataaaagatgctccgactactcatcggagtcaacttcttcaaccgggagaagttcgggggcgattggcgtggctgctcgggccggaatagcatcgggggtccgagccacctcacctttggtaacctgatccgaaacggcttcctccacggtagtgtgatcccccgacgtcgggtcggcaacctcttctgtgacttggccctctgaccctaggggaacgatgctgctgaggtcaagctccagatacagaccctgaactgcaccccagtagtcctcgtaccccactcggtatgaggcgaaaccgctctccaagagctcctcccgatattcgtcggagccgcggaagtcctccaccacccgactcattacctctttcgccgactctgcctccgccctcgctatgtctgcattggcttgagcggtggataagtactcctcgaccttgacgagattctccagactcacctggagttgctcgcgcttggctttctccagatgcaatcatcccactcacgctgcagccggcgagcggtacgggactttcgtttgacttcctcacgagccgaccgaagttcggcccccgaggcagccagggcatcggtaaggtgggagatctcctcctcgagtcgggcctcacgatcgaccgattgcttcagctgctcgaccattgtcgccttctcggcctcgacggcctcggccctattctttcggccgctcagagatcgnnnnnnnnnnnnnnnnnnnnagggaagaagaaaagctcacctggatcatagtcgggtagaaggaagaaagcatgtcggacacccaccgactcttcatgatctcccgatcggccgggaggatggtcgccttacataacatcctgaccaaatcatggttggctagggccgatgctccttcgggaagcgggatgccggatggtgcggctcggccggccgaccttgtgtcgtcgcccggtaccatcggagccttccttcgtccgaccacccaggctcaaaaatcgaagtgggacgggaagcttgagctcgattgggtccctcccgaagctgcgacggcggccgctgcagatcgtttgggctcgcgtacttcggcccgaacctcttctgttggtgggggagccgacgctccttcggctaccccctcgatcgccccttcctcggatggcacctcaggcggcaccaccggcatcgacagagcaatgataggctcatagtccgacgcccgttcggcgtcgggctgcgctcccatcgccacagggtcggtcggcgatgctatctaaggcctcttgggaggccgcgatggttcggctccgtgcgccggcctctttctcgccgcatgttgtcgaatgtcggcatccgtcagcctcaccctcgacggcatgtctacaattttaacagaggatcagcaccagtccaaagacagagaaaaaaagataaaaatgacagatcgagatgtacctaaatgaggaaccaaacttagaccgacgtcgtacagagcttgctcggtgatgagctccctctgcttcgacaccgacacatccttcagtcggtgaaagtcctctcgatctccatcctccacccgactgttctcattcggctgagttcgggggtccccccagcgggaaggaaatctccaaggaagcggagaagaggcaaagaaaaattgattcttccacccatgaatcgacgatggaagatcggtgatgaacgaaagatccttccgggggttgaagaaccaccaccctcgggccttcaggtggggtcggaggataaagaacatccagaaaagagagatacgaggataggtcggcaaaagccgacacaacaacacgaagctgattatcagtcagactgagttcggtgccagttgagccggacaaagctcgtaattatccagaacgtttcggacgaactccggaatcgggaagcgaagatttgtccgaaggttctcgacatagaaggccacctgatccggaggcgggttgttaacccgaccctcagccccaggggcgaagagctcgaactgctctaggatattgtattgcttcctgagctgttcgatgtttgccctcgaaagtgaagaaacctccacctctggagtcgatcgtgagtcgtcggtcaggttcttcgactgacttccttgtggagaggttctggccatgatgctagaaccgaggtcggaggatgaagaagaagaagaagaaagaaagtccaaaggaaacgaaagaagtaaaaaatgcaaggagacaaaaatctcaaaaaaagcttcccgaggagggagacaggcacaactacctggaacttggaactgggggaccactcgaccagagtctcgacaacagactgtgaaaagtggagttttggatacaggtgacctaatatatatagtgcccctcgacggtcgggatgagagcatgcccaacgagggtctcccggattttgacacgtggcagcatctgggccttccctcggtttaacgattcgatgcacctgccccagatcaagccacgtcgcctccatctgcctgaacaggttcggcccaatggccccctgccacatgacgaaagaaccacatcttaggattcactaaccgacggcgatttgcgttcccgaggagacggcgaaaatgacggttcctgtttccaatgggacgtctgacaccaatgggacgtctgacgccgaaccgttcattggtacggtcgaagccatcacacatgcgaaaacgctggccagcacgacatctgactcaggagtggggggggcaactgttgggatataccgactgaccccttttacgccgactcatcctcggacctgtccgaccgacgtctgactctattgaccgcaccgaccgacgactgccgacagtagctgccgacattatccgaccaaaggtgtgtcggtcaggcagatccattctgtttccgactagccgagtggcggagtccagattaccgactcactgtcggacaggggtggcagccgacgtccgactcctgcaatgcgccagaccagccgacggtgtccttggatcttcacccgatgttccgcagtcgaataccgatgtatggtcggtcagctcccccaaacaccgtacgactgctatgggctgctgtcttgactaggtcatgcgacgtggccaccctgggggcatcatcctgccaaggacataggtcagccccagtgatttgacagcccacggtgacttgtcagtccacggcgattctgacagcctccggcgatttaacaactctccggttgtctacgccattaatggcgggatcacgccgcgctctactataaaacggggaaggcaacagtgttggtggaggaggaggtttttctaagctcttgagctctctctctctctccctagctctctcccactgagcccctgattcttttctactgttgcctagtctcctctctgacttgaccgtcggagggtccccaccggaggcatctccgatcagtatggatttctcttgcaggtgctcgttcccgacgaccagacgatgaggggattggccgtaacacacctcatattatccgatactcgctagcatcttggacctatcggttccacaacctaattactttctatgtgcttaacatgacctcatgtagccggaaccctgatcctagctagtagtccttatctgcatcaccaagtcgccaagcatgctatgtttgattaaaagtttaaaaccaactctcctccataacttattttgtggcactcgcctttccaattctccacaccatctccatcatctatgatggtaatctctatcatctatttaagcgcatcatcatgttaaaattgtgcatctcacttatttactctctaaaactagggtaacagaggtagaacctaaatgaaaacaataatataattatcaatttagtttaagcaaatactattcaaatccgaatcatccattaatataattttggataggatcaagacaaacaaggaaatgtattttatctgattatgtcattatggaaacttcaaaaagattactcccattataggcacctttctttttcaaggttggcgtccatgctcacaactgatatctcttgcgaaagatctttgcaagtgtgatttcctattctggatatgcatgactcaaaaaataaacaacaaaattctgtgactgatttctcatattatgttcaagccttttcacttcatctgatgccttgttggtggcaaatgcactctgggtgcttttctttttggggacacaattgccacactgcatcttcttattcgacacacatatatgatactcttgcaattgcagtagttatcatttcccctgctagttgatttgtcacatcttcataccagatacttgtttgttctgtgaatgcaagtgtgataactagaggcactgtcttttcatttgacattcacaacattaccttccgattcttcttggtttttagttgtcaaagttgcgatgccatgttgtgagtatccatgcctacccaaggaacctcatcaattcttttattagtttggtattctgaaatgcatgttccataggcagaaagagtagctcgccctgctgggactcatcacatgagttggaggccagccgctgcaagttcatctgccgtctcaacaagtgcaggtcctctttacccccttttagggatttaccaattgattttgtacggctgcttatatcttcttaagacacaatttatctaggcaagtgctgtgatttgtcagcatggcactcatccatgtttgagcatcaatccaagctcctttagtgatagccaaggctaagttggtaacatgagaaatccatcaaatggatgcagtcaacgagtgcaactcgttgtcgggttttgctgctccaatgatagatgtaggtggccatagtgttcacaacatacatttgattgagtgatttgttaagtatggtagcgcggacttgtgccgagctaatatgggatttcccggcaatgagggtagtcttggtgaggcaggaggaaactttgaccgtgggagaatatggatcagatgttgaaagttgataggaaactggcggcggaggagagttgcagggtgatgagaactgttaggcatactagagtggctaagaatggaagatggagcaaaggcgctcatttgttggtgtcctagtcggagtgtttgcgtgtgtgttaggacagcctcctttaggcaaaggtggagatactaagagtgcatttggttacactttttatttttaatttttaaaaaatatttttatttttttaatttttgttattgaataaaagtaaaaaataaaaaagtatgtttggtaactacattactataaagcaaaaaacaacgtttagaaatggcaggtgaagagctcaacgagagagtttattcaggaagagaggaagaacgagatggggaggtgaagagctcgacaagaaagaaggattcggactttttactttttggtttggcattttagatgtgtggaagcaaaaaaaaatagaaaagcaagttttgaaaagcaaaaaatttgtatttttcatataaagtaattattttgattattttgatttttactttttatagtattatcaaacattactttttaattttatttttaaaaattaaaaattaaaaattaaaaatattttttaattgataaccaaactcaccctaatagatagaattgatggttccattatatctcctatcaaagaagaaggattgtggcactatgtcttcaaggaagaaagagtgaccatggcaattgtgatatacatacgtaggaagtaatagagagaatgaagcaaatgttcaaattgatggaggaactgtctcctacctcagaaaaagaaaagaacatggagaaggaatagaagatggtggcaccatatgtcctactcaaaacacacacacacacacaaaggtaaaagtaaaaatagaaacatggcggcattatatatgcaaacgagaaatggagaatattaccaatgtttatggtatgcttttatatgtttagggatatggcttgagttcacttataaaattggtaatattgcaagtatttatgctcgattttagaagagatgtacctcctccattgcaactgcatattatgcagcgatggagatatcaatagcggccagtggtgatggcactttatctcctacacggtggcaatacacttgtaaagaataattaggagttgtaaacattccaagatttgctcaaaaggaaaaggagcatattctaaaagtgcaaatgaaacgggagaaagcttttcccgcacgtgcgggacttgaggaccccaaatttttcttcggctcaatctaaattcttaattattcagtaccgtaatatctataatattgaaagaataactaaatacccccagcatcaatttagagatcctaaatgggtgcttctggaggaaggtcataagttaaaagcacttgggactcaagtccagggtaatctgaaagaaaactgacttcacataccgtagctccaaaagggaatatattacgtcagtatcctgcgcaattgcattttcatgtgcgtgtacatggatgggagagaggggagagtaagggcttggtccattaatcagctcaagtgtggagatctgcacgaatctcagcctgcatggtggaaaagaaaggaaaaaaaaaaatcttcagaccttatgtgactagcatgtgtggcggatgggagtccgcctcctccctcgagtctgatggaaaggagacttctaaagcttgtcaattctagcaatacctaggagtctctctataagaagccctcctatcttccctttaatcatctcgcccctaaaccccaagtaaccatcggcaaatcttgtcgagtctccctaattttctgttgagatttctcagcaagtcgccgttcgtatctcactagaaaagaaggaagcaactgtctggataataaaacagtgtaaggtactatataacctagtttttagatcgaggtgtgagaaaatatacatgatgtttgagcttgtcaccaattgaagtaagaatttctatacacaatcatctaaatggatatatggatttgtatgtagcatgcatcaatgaatttggaattttgcattgtttgtcgtgtgattactgatttattttcaatctgaatttataaatatatgtttttggattgtatctaatatagatgattttggttgctccaaatatgatgcttggtgttttggatttggcaagaaatattatataaaattatacgaaaattttatttttggcgaaactggatgactacaagaccgtataaatgggatatggactagtcatattatggatcgatagtcatgggtcaaattgtgacattttggtttgccatcataagtcgaaatattgatattatagattgcttgtccgagattgaattgcacgtggtactttagtccgccgcaacgggtcaaaacatggatattatgatacatttccatagactgaagtttaggattatggtttctagccacaagttaaaatatgagattaggccgaagcataaccatagatcatccaaattagaaagataattattgataaaaaaatctaaatagtaacaaaagattagataaataaaaattgttattaaacaaaagctttagattgacgatatatttgatatatttttttgaatgagatgtatatttgatggcatacatttatgtgcataattatatagatttatttgagctatgctaaataattggtatgagattttatgatttttgcctatatttggtatggtttatagttaatttttattattttatctatattggtgtgagtgtgcaggattcttactagattgtaaagctcatgccatctctctcttgtttattttataattgcaagacacttagtttggaatgagttgggcatggaattggatcaagatgaagttattagttggagagttgacttctctttgtgatgccagatgaatatttgaattttgtagctgagtaaactcttctaatgatggatttatttagttagactatcatgactaaattttatgattaatttaattttttttggagctattggaaactttattcaccttgtaaactttgtatgacttttaggacatcactttaggtattgtttggtaggagatgatatttcacatcaccctagtgatatgagttaggtgatatgatcatcttatttggtattgcaaaattctatccagtaatgaaggatccagtgataaatttgatgatagcatcactacacaatgcagtgactccagataatagcacatcatcggataccggtgatatgctgaaattattttgggataaaaatatttctagtcaataaattgggaagaaaataaaaattctcctcttctttttctatagatgtctatctactagatgtgttttttatttttattgataggtttagttaaatgatatggatattttttatttatttattagatatctattttattttcataagtagatatggttaattggcatggatggatcatattaaattcttcatatttttttctcaatttattttgatgggctaaatcattgctaatggacagtcctaatattgatagtcaaaattggctaagcctaatcaagcctgattatatataatattattataatatcattttaatagattcatcaaaataaatattcataataataataaataaataataaatattattattattactactactacatgtttttgtaaggagttataaaggaagaatgcttaatcaaattgtagagtaattattatgcactaatgtacaaagttatttataatattttatatattattattatcactatttggtgatataccaaacacaatgaagttttatttccagtaatatttcagggatatatcaaacacggtgattacatatcacctcagtatttgtaaatcatctcagtattcatatcatcccagtgatcacatcacttcagtgattatatcaccgatgatgtaccaaatagtaccttaagattcatgtagccatgtcacgtagccaacttggatgatagagatgggcatgccatagagactctagaccatatagcaagaaccacaccatatcctccacgttgttttgtatggcaaaattgaagtttttaacccataaaataggttagattgggcttgacatagaatttggtccaagatcaaagacctcccggccatcctaaatgaggattaaggacatgcaagagctagcttgcggaagatcatgatgaagtgggcaagtagctgttggtgttacctcgctggttaatctaagtattaagtcctttccccccttcacatttcttatgtttgaaatatgtacatacctttttctccactttgatacattgggtaacttaacctccccttaaaataaaagttaatcatggaattttgctattattggcaacccttgtgtcatcccctagtgaacatttttggtcgctcctttaaatttcgcattgagcccatgctcccacacatggctgtgcactgcgaagacggcgcatgttatcgagtgacggtaaaggttttgctgatgctcaactttttccggctatatttttttttgattgaaactttttccggctttttgaagcccatttttagtacctgttatgagcacacttcataaggaatctggcattcttccctcgggcaggaagtgtcgatggcggggaaattatttgtacaccacatgtggtacagaatattgtaccatctgatggtttttatattttaatatttatttaatatttataaatttttttttaattaaattttaaataataaaaaatatttttatttaaaaaaattataatattttatgatgatattattacatcgatgaaattataattttttgtataaaatatcataataaaaaattatttttattatttaaaaaatttaaatggtaaaaatattttattaaaattataatattttataaaaaattataaaaaatatttttattatttaaaattttaaataaaaataaaattaaaaatattaaatatgtgttgaaaaatagtgccgacgtccggtgcttttttctctgcacggtaggcggtgtactgaaaatttctagcagatgtgatgcgctccggaccgttgaagtcttttggctagtcggtctctattaaattcggcaatccctgtgccgtcttctcctttgttctctaggcccgaacatcgcccaaacccaaaaggctttccgtttgttcgtcgcaagaatcgccggacgagaggtcgagtggagagcgagagggaaagagagggacagatggaggagatcatagcgggcgttctctgtatgcttctcgtattttctctcttccctcttctttggtggaggcgccgtgagatcgctcgatcccctcacgagcacgatgaagaaccccaacgccaacaggtgaatccaatcccacacctttttcccttcttttgattttgctcggaatcttttctttcttttttagattttagggtttcgattaatcttgtaaatttctgatgcaaaaacagtgatgaagagagatttgccatcgctgtgtgatcagtttttcttttcgaactgaaagctagaggagctgatcacataaccaatgaaatttatgattcaaattatgtcgtataaacaagtcaaaggcgaggaaaagaagacgtcgaagtcagaatttttaacagcgcaagagttagaaaagagatttttttttgttttattacactggcaaaattaaatacaataagattgttattgataagagaaaataaagttcttgcttcattttctttcatctagatgatttggaagttcttgaaatcttggagggcttctcctgctatgtcccaaaattgtgggctccgtattaatttgctaaaccctagaaaattttcaaactctaatgagacatattcataaaacttcagcgggcaaggaaaatattagttatccccacagatgatggggcttctaaaaggtcgagttattggaaagactccaagaaagccttataaccatgatatactaatttgtcgtaaattatatagcaacaatgaatatagacatgattttttagggcatgtttattaaagaaactgctggagctagaacctaggcagtaagattcttcatttatgggataaagaaacaaatccaagaaattcagtattatgggtgtggtcaactagtcatcgtgctggccatcaatgttgaaggttgattgagttggcatatggggtcttttatttaaggcaggattgtcttgcagcagtcacaagattccaaatcagatgattgaaaaatgtgaataaccaaagcagaagagtttattttaatcttatttttataacattagtattagcatatttgttgacacttaaaacaagcacaggtaacatatggaaatctttaagggcaacaacacgaatactaaaaaagcggaaactttggcatttatattctgattgcattagacaattgttgataattcataatgcagaattggagaaggaaggaaaaattaatcaaatggaggagggctatagaacagataagctcatttctcctactaactgattcgccatatgttcataccctatacttgtttattctgtgaatgtgactgtaataactagaggcactgtgtcttttcatttgaggtttacaacaataccttcccattcttccaagcttttagctgttaaatatgcgatgccatgctgtgaatatccatgcttacataaggaaccttatcaatttttttattacttttgtattctgaaatgcatgttccacaggtagaaagagtagctcgccctgctgggactcgtcgcatgcgtcggaggccagctgctgcaagttcatctgctgcctcaacaagtgcaggtcctctttgcccccttctagtgatttgctcataccaattgattctgtgcatttgcttataccttcttaagaaacattttcattaatagttttgcctgattattctcctatattctatttccatgattgttctttctcttagtctttcatttcactcttgtttgcataagtattgatattggatctggcaactttaatttttttaataaattgtgccttttggtatcatcagcatgaaaataatgaagttggttgaaattgaaaatcttttaaagttagaatcacagatgtgagaaactaatgcagtttgatcccctaaagctttgctagactaggtctgtcaatgtcctatagtctgggttgctggaaagatgcctaaatagctaaggatcgtgagagtccttaatcacaccaggacttctattttctcttcccaagccctatttacctgtcctataagaaaaattagaggctaacaaaaataggaagtattggagatcagtttggcaatatttgttagttttattttgaataatatcattgaatagtctttataccaagtttatatacactggctatcttgctaattttgaagtctccattagtagcatgtagtggctaccgaccttttttataatcaaaacaacctttccttggctttttctttgtatactagtttcgcaggtcattttttaggactcatgtgttagtttgtgggtcacagcctcttgctagtgttctttactaatgacaagtatctactctttggtttcaggtttccttgagcttcattccaggtttctttaggttaaagttaaacattcatgtatatgtcccttgtctcgttgtcctttcctgcttctggcagacattgacttaagagtgttgcagcctgattgctctttcctttcctggaagttgtggttcatgaatattaggcacttcatgaatagcaagtacctcctatgttgtatttcttgctaggtttatactctcatagtatgacatcctatgatattttacatatattgcaacatttacaccctcattttgctctcgatacctattcttccatcaactttatatgcatattttatatctatatcagtgatgtgtaatgcatggctagtgtgaattctagcagattgagtgcaagagtatactggcctaatgtacatattcatgggctaacaagatatttagcttcacctcaaattgcggattgtgatactatggtgttgcctggcaatactaggaggtgcacttggttaccatctattccaatttctctccctttctctaaatttttgtaatcttgtggttctcagaaaagtaaaaatgtttttatcaccttaagcttcaggttgatcatattttcaactttttctatgttttcgaattttgacaacatctgctgaattttgagttgatattcagaggctcttgatgaaagtgatgaggaggtggctgaggctgattattatgttgctaaagcatctaagaaaaaggaaaagaaaaagcaagagcgtgaagctcaaagacaggtggattatcttttggattttttcccttcatttctggtcttcgttaggtcaatgctattgttgagacactggcatatcttttattaggctgaggaagcatcacgtgaattaagaaagacaaagcaagatcactatgcagaaatgcgtaggaagaaggatgaggagcgtgaagcacaagaacatttgatggttggtgatagtattgttagcatgcttttgaaattatgaaataattctatactaaagcagcatgtaagttgatataggaggaagaagctagggctcaacaagccaaggaggaggaagctgcagctctagagtttgagaaatggaaaggggaattttcagttgatgctgagggtacaacggaaaatgaactgcaagatgagaaccagggtcaactctttaattttgtggaatacatcaaggtaggcatctcttttcattttatatgaactatttactctttatattttttatttatgtgtctcctatgagatgtctatctttggctttatttacttatgtttgacttaaccgataccatggtataattttttttttcgggattgttataatgtgttgattttggttggatgattgatttctgtagcaagtctaccaaaaataggtgaaagaagtctggattatgaacgcatacaaggtttgatgagaatcatggtaactgagatgttttgcaatattatttgcttcatctggaatttgattctcctgggatagttcatataacttagggaacccttccctccaccaaaaaagtcctaactctcccctcgccctccccctttgtgcttcttcctctcccttgtgtttttaatgcctgatttgttcaactgtgcaggaggtcatcatttaccgtgcactatgagaaatataaaaaaaatgaactaatacctcgctatagatgttgttcattccttgtttttttttcacccttgtggctgcatgtaccatgcccatgcaaaaaagcgaatggttaaccttaggttgagaacaagtcaggacatagatttttgatgatgaaatgaaccctcatttgcaaggtacactatacagtcctaaaccatacggtacagggcatatcatatcataccagtacatgatacaggaggtgtaccgacacttggtaatgctgaatcggcttttgtattggacgtactaacacaatgagagggtggcaccgatatagagcccgataccaagacggcataccttgctcatttgacatatttgccaagtaccaaccataaagaccggagttaaacttaattagatgttagaacataaatgcaacgactattgatccaccttagtatcctttttttattacatccaatctttataatagggtccttgattaccttctaaggtaatttaaagttcaaagtttgatagctctagacattctgctctgctttattgcagaaacatatataagtgtaagcatgattgtttttactataagcattctggtaattagttgtctacactttctccactttcttggctctagcacaaaattgaacatttcttttggcaggatatcctcatactcttatgttatggacacataacatccgaatgttaacactgcactactttctaaccccatgtttctgtgctttgtgcacatcaaccttttaattctcatccttgtagatgcaatatatctacatctcatctatcatattatttacctttgattcttctctctttaatgaaatttgaattttcagagaattttgttaaattccttttgtaggatgaaggtagtatgacctatgattaagttagatgcataggcatctaggagtttaatattgaagcaatatgaaggaagaaattcttttcctcgctttttctataggctatcaccactaactaaatcttctaggtcagactcttgggaaagacttcttaaggttagggcctataacatcctcccaagtgggggatttaagcacagggacccagttggtatagaatataaggaactcttggcgaaagcatttcccagtccaaatgtagtcccttctctcattatctgactctgtacaaggtccaagttttaacatcaatgtaggtcttaattttgcaaatattgttaacatgatctccatttcatgtgtgtgcatgtaaaactaccaccaccagaatgccaactttcctttttccactcgtgcggtataaaaatgattgcccttaaaagttatgtagctttgtctcgtgttgacctatgacaattctttgagctatacccaccccatcaactgagaattaggactatgacctacatcattggtgcatattatgttaatcatattaagaggacatttattattaataaattaatgaaactactgatagatacttgataagaatattgtatcctctcaatgattccaactagctttgaggtgtaaattttattttcctccttgcaaattttgcatttgctggagaacctataaataggttggtgaaagttaaaacaataacctttgacctggtttaatgttggagcttttgattgcagggttgcattcagaagggagattagtttaagttggtagataagctaaaattttcagagtgaatgtggtatcctactcatatgaaagatccttggttttatgtttttatcctacaatgatgttccagtacatgatttttctgtgatgactggtgataaggatgtctggtattcatattacctttaaaaggcactcaggaattaagacattggtgatttaaccttctttctagtgctatataagggcatttgtacttttacatgaagaactcgagtttgacgtgctgtatgatagaaaaggatgagcttccacagtacattgatatagttagatacgagttaagggattttgcaggtccttttaccagggtttgatgaagaaatcagattgatgaaaatcaaagtgacaaatagttgtgctctaatattcagttgtctttctttccgttggttgatatttctttagaattcaaaatctggaatccaatggaccattggaaaaaaggtagttgattggcctgtggtttttggcgaggttccaacatgtgaatatcatttgaaaaagggtagaaatcagacaaagcttgtgtaaaaggatcaggacaagttttcacccccaactgcgaaaagccatggttggcattgcttgagctcctattcttgctctctgcttgttatgactcatgagtaagatttgtatacttatttcagattcattctcagcagagcaagatgaacttcagttcaataacttcaatggtttgggctgtggttttggcattttttgttaaagaaaattataaaagatccagttaagcttatgaattgtaaattgtaaagaaaaaataaaattagccaagttaatgtactatgtgcaagtttaaattatatttatattgtttgggaccttcgcatgtatttatttggttgtcgtgcactgaaataagctttgtatttttttttttaaaaaagccaagttaatgtgctatgtgcaattttaaattatatttatattctttgggacctttgcttgtattattttggcagtcttgcgctgagacaagcttttttgactgttcaaatgaccatgttaaagttgaatatgttgttttagttttttgatggaaatattatggaacctatgaatatgaatgtccatgagatcttccttcattgtaatttaacctctcattaataaaattgggtctcttttttcctcccttttcatcaaagggaaaaaatatgactatctgtgaaatttgagcttttggatattttacccatgttagaagatcactttttttctaaatgtcttttgaatttaatgttgcagtgccttctcttctatttctaattcaagagctttatttggttatgcacttgtcttaagctgtgcttaatgaacatatatcctaatttattttgtggattgaattggataagttcactggacttaaaaagattctttgcctaatacttcaggtggtatgtaagtagatggcaggttggattctaaacttcctttgttttgattgctagatgattattcttgtgctttaataggaatcttgccatatgatgctttggctacaatcaccaacactttgcatcagcacttggttccagtttctgaaataattactcctggcacagagtagacattcatgaactgtgttgctgaacaactaaatcagtgcatcagacagttaaaagccctaggtttgcttccatagtggcctatcaagaaatattaaatttgacagagagtaaacaaacttcttatcagtttgcatgcttgtgaataaatgcttactggaaatacatgcttttgttgctgctcaagcctgctctaatgcaatcaaaattaaccaggcatggttacatgcactctattctttgttggtgaatgtgggagaatttttttggttgcatagcatatgcatctggtgaggatcaatattgatcttggtggtgtccatgcaactgcaagtctatgcataaatgactggatgtatgatgaagtcatatctacaaaatgagaacaccacaagactagtactaattttttatgtttcattgattcagaaacagaaatgcatcccattggaagatcttgcagcagaattcaagctgcgcactcaggtattgtcaatggtctgccaagaatggttattttcagtgctataattctgatatgaagtcattttgcatttaaacatttcatatacaaattgcatgcttttttactatccttttattttcctttactgtaggaaatttgcttagtttgttaatttgctctgcatcttatccacctttctagtgatgcatgcgtggccatatcacacttggccttaaaaatgattacacctctactattcctatttcaaaaatttattatgcttatactgttgacatgcaacccaaccaaatgcgtgatcaattgttacaaagttgtgatctttaattcatgttagaatcctagttcatctgtgttgacttccatgaaaatgcctgtctaatgttttattcttttaaatgcctggtggttttgcaggactgcatcaatcgaataatatcactggagagtatgggtatgtgtcacgagctcttgtcattcctattcggtcttttactgcttcataagactaaatttgtatgtggagaatcatctaatcaccagcaaactactaaatttgttctggtttttatctatctggctcattgccttccatcatgggtatttcttactgctgttgcacccttgatttctcattattttacagggtaataccaccttgagatgcaatgctttaaagatgttctggattatctcttaataactaatggaagatttagttgctgactgttgctcggcaaattaatgttacttcgatgctaaacaaatattggattttttctgttgtgcaggaagattatctggtgtcatggatgatcgtggcaagtatatatacatcgcacctgaggaaatgaaggcagttgcagattacatcaaacggcaaggaagagtcagcatttcacatcttgccagcaaatccaaccagttcattgatttggagccaaagcctcagtttgatgaacaaaattcagatgggattgctgttgcataggccttgtctaaatatatgtggcattatatttcttttggtacagttattttgtacccagaccatgaagaaatgccttatgtctgatgcagccagtcctcgtactattgttgaccttggaaatttcaatgccaggaggaagctgtcaattggatagcggtgccaggattaggtgttttagattgaatggtgggcatggaaaagaggtagatatctaacatcatgagagtgataggatctaaacaactctgtgatgtgtgctcaaatcttatgttagctgttgtcatctctgtgttttttcgttatcatgatttatatactgcactcacaacagtttttaataataataataataataataatagtagcagcagcagcagctgagcagcagcagtagcaactgagtagtagtagtaatagcagcagcagcagctgagtaggagcagcagcagtaataataattattattattattatctttttttttatttttagtagtagtagtagtagtaattattattagtagtagtagtagtaataattattttctttttttcattgtttgagttgggggattgggataaagtagtagtagcagcagcagcagcagctgagtagtagcagcagcagcaatagtagtagtaattattattattattattttttattttttttcattgtttgagttgggggattgggataaagtagtagtagtagtaataataataataattatttttttttatttttctttttttcgttgtttgagttgggtgattgggataaaacaccctgaatgttgtttggagtgtttctttcgtttttcggtatcacggagtgtttctttcttaatggtgaatctatacgcagactctgtcaccgtattcacgcaaggtcttgtaagtttcatttggttagacttgcaagctttggcacccagttagatgtccacccatcaacatggtcgttgtaagataagttgccctggtcttctgctgtgcactgcactgtgtgatatacagtatgcaaggtcacgtgcacagtgggttgtgtgatgcatgttttgcatgcagccattcatggatggtatgtgtgatgtaccatatcgtgtggtgcatcgtgcatacgatagggaatccacatccaaaataagaacgcttgaagtgaattttcatgctttcctacggcaccatacctgtcaatctaaaccgttgaattttttattggatgacattattgcatgacattaaaaggctgttaaatgatgataatgatttgcttatcaaaaaaaaattgataataatgatttcatgtaatagaatgaaaggctctctaatctcatttgaaaagaaaataaataaggctctctttgacctcctgattcaaaattaaaaaaaatattaaaaaatattagcaagtttcaggtttgcgaatttttttatgaggctagtcacaagatccgatctgaaagacgtaaaggtcggtttgtgggctggctcatttatatccataatgcagctatgtataaaaatatataactattcttttgcagtgacaggaaaaatcttgtctgcaaaaaaattttatttttatttttattttttatatttgtgtgtatatatatacacagatacatacacaatctttacatttcttattcacttatgctattactcttacaatttttttttttgtcaaagcttcatgacgcaataatgcgtgacgaatcgaggggaaggcatcatacaagtaccatccattcacgtggcatgccgagactagatcagcctcgtacgaagtccaacagattttataatttcctgttaattgtgtgatgtgataaatatgattcaatttttggctgtcgcactcctttggcgtatcatgggacgacggaaggcaaagttttcaacgtagatatcagaaacgggagtacctatataaaggtcggtgtttggccgacttcacatgtataaaagatctcgctagacgctcaggaataagaggtcgcgtaagacgtaagctgcgaggtctttgtaacggctacgagagccccagctatataaggagtcgcagtcctaccgatagctgtcccaatacgcacccgctcggttctccctccggcttctcctgataccaggactgttcttggcatccatggaggtttctttttttaccctaagcactgctcctttcttgttcttcttcttcacattctcgttgtcttattcctatcccacattatcttattcttgaaccagatgcagcctttgtggcgcttaaaactgttcttgaaatcaaaccccatctcgtctctcctctcctctgcttgtcttctcttcttgaacgatgggcgaggcaactctggaaggcctgccgtaccgtaggcaaccagtatgcagccattgttggatgaagaggtcgcggaaggggaagggaagggggattttttggtaacggtcttatccattcaagaatctgacagagcctctgagttctgggtcttttcctctttcttcttcttagtgtccttttctctttctttcttgcttttcttcccccgtattgggaaagtggcagcggtttatggtttatctgaagaggctgtgatgagttcttgatgaacattttgttgcattgtgaagtataaaacgattatttctaacggcaaggcaatcttggacggtctgctgttgttctgcaggcaactggatgcagccgcttaggcttgtagttcaaagacttgatgactcccaacacgatgctggattaagcggtaaatctgagcctcttcctcccttgactttgcaatttcttccccctcccttcaaggatttcgtttttcaagagttctttaatttcttcaccataattaatttattcagataattttttttctgtctccccaagaattcatacaatttggagaccattgaaagagtgggttggggatcttgcattgctagtcactagggttttgagaacccaaattctaaaatcttctatcttggttcatgattaaggattgtatgctgggcattagagttaaaacatatgtgaagggttttgaatctaccccctttcagccacatattctcaatttttgttactcattttctcagcttcttttttcttagggggcaaatgctttggtactgcatatattcctttttccttccctgctctctattctcttggttctatgagcagcaataatatacaagacaacttgaaaagtctccaatgctatcctccagaccaaattctgtgttactttaattatgctggtttctttagcattgctattgtaatgtcgctagctgaggagctgaccaggatttgtgacaactttaagttgcttcatttttagagtctcttttgtgcaagaattggatgagcatataaattttgctggattccatatcaaataaggttatccactctaactttcccttgataaccttctcaatctcattaatatttaatagagccattcaactatttattctattgatttatttacttttctttttcttagtcttcctacttatctctacagaggtagcgctaatctgttttgctatatgtttttatgcttcagacacctggatcttatttcatattgctatcaagtggtgtacaagtgcttctccaagaattttgatacaatatcttcgaatttgacatgaactgtgtccgttacaactatttataagattctttgctcttaaatatgttagtattgcttgtccaagagacttattcatgtgagcagttactcaccatatatttttattttcatttcaagcaaaaatatatttttgaaattgagacttttaatacttatccttatatttttgcaatataatttacagattagttgggagaaagtggaaaaaaaatgtaaacatcgtattatttttgtaatttgaaaagtcagttgttctgcaggttactgctgcagcatattggagatcagacatgatttctggtaggcaggaaaaataagccttttgtcttattcaactccacataatgtcttcttctgtttttgcatggcggggaacactattaatttaactcaatctcctctcctcttcctgtctattctaacaatgttggagtaatttttatggtctgctgtggttgttggggtctttcagatgcatggatggggtctgttagatgcaggagtcatcagagcctcaaaatcctacttcacagctctttcactgatccatattcattggatatgcctaagactattactatttgtggaaacaaaggtgccttcaaagactttggttgatctttattatgaggcttttggaagaacttggatggttgcctcttcaatggttatcattgcacggaaagagatttatacatataagtcttctttcattctttttttttttaaaataattctaatgatctatattttttgtgaagctttggtgaatttttcccaatggtagacaaatatttttgttgtttcctcttagcaagtctattggaaatgacaaggcaggagtacaccacagggtatataaaggattacattgctaccgacagctgacccattacctgcctgctcagttctccagcttcccctgatatcagagtggttcttggcacctatgaaggtttattttattatcctaggactcctctcttcttcttcttcttcttcagcttctccttgtcttattcctatcacatgttagctaattcttgaaccaaatgcagcctttttgcagcttaaagctgttcttgaaaatgacttccatctcgcatcgaacaatctccagcggagtgggggccctcatggtcagagggggtagctacgctagtgccccccccctcatggtcagagggggtagctacgctggttgccccccccctcactcctttttcttaccaaaaaaaaaaagaaaagaaaagacttccatctcgtctctcctctcctctgcttgtcttctcttcttgaatgatgggcaaggcaactctggagggcctgcagtttttcaggcagctagtctgcagtcattgttcgatggagaggtcacttgaggaggggagttctttcggtttcagtctcatccattcaagagtaccgtggagcctctgagccctgggtcttctcttctggaatgatgggcaaggcaactctggaaggcctgctgtttttcaggcaaccagtatgcggccattgttggatggagaggttgcttgagcagaagagctcttttggtttcagtatcatccattcaaggataccatggagcctctgagccctaggtcttcttcttcttcttctggtggattaagtggtgaatttgagtcactttctcccgcctgagtcacttcctccccttgtttgctttgaatttcttcttctcccctacaaagattttattttttcaaagtttctctaatatctttactataattaatttctttggataattttttcttcggatccccaagaatacatacagctaggagaccattgaaagatagcagtgggaatcttgcattgatagttgctagggttctgagaaccccaaatataacttaattatagacttgaatttgttttacagagtcgagctggttgtatgctgagcattcaaacaatggaattagtggaaccagttatcttaacttactctgtgacctttaccataatgataaggtaaagcaataagagttttatcatgctgaattggtctatgtgggccaacactttttcaggtttcatacatgtgaagatgttctaatattgagtttgttgctttgatagaaattagtcagttttttcctaattaatattttaatttaatttatattagtatctgcaattgaaagcttgcaatattttcagaaccaagggaacaaaaaggtgactagatattagaatggcaaatgaaatggagaactaaaattggtgggaactaaagatgtctgctggtggttgctttttcagctaacatctgcatcttaatttaagcctttgaggcatatcaaacaagcacggaagcctctgataaacaggagtttgactaacatacatgttagcatttatgcagagtttcattgttccttctatcttgaaatgtgtgaacacacttaggatttctattaatggctgtcagttttattttggaataaaagagagcaactgatctctaatagttatgaaaggcaatgagtatgttttaagttctattgcagaaatctcaggtggaatcagtgttttatgttgcttattggcatatggtggtaattctagtcagtagatccaaaaggcaatagaactataaattgtttagggagtcgttttgcactattttcgtgccttgaaccatttgagtaatggttgttatatgcaattggtagataacggccagtaattttgatttacttgagacacgctactgaaagatactcatacagaattccctttaagatggtgctgtagcgcgaggcatgaaccatgagtatttatagtgaattagtactgcactcaacatgtatgaaatcttatacctacgataacaatcctgcttggaatcttctctgagtcttgaacctgcacaaacttctgaagtgctttcttactaaaagtttttctaaaaaaaaagcacctccctgcatccactctcactcctatttctggaaactaagtgactaacactaataacgatattgccttttcttttgtacaactgtgccttgttgtaaatcaactttcaccctggatggcaaacccttcctagcttgtagcactggctatgttttctcctcctcatgtaattatatgatggcaaatagcttatttaagtaaaatttgaggaaagtgtctcacttcttctattttccatccaaaaaaaaaaactgtgtcgtttgtagatctccaggtgtcgacagtcattagggctctgaatgtcgaatgttttctccatctacctaatttctaaaaattttgtatcattcatgtttcctaaattttggagtgatttctaagtttgtgtcaaaattttgttgcacagggccctatcagttctagccttgaagccaatgcaatactagtgattgtgctccaatttcagaatgaaacgcaacagctcaaatagaatagtaagattatgtttgaaagcctcgtatttaccaaaaaaggaaacagccatggaaaaatgcacttttgaaagaggcaaaaggctacacggtatttaagaaggagctctgtcagagggacagcaagattagacccgcagaactgggtccttctcataatttctctatttcttttgatgtactgcaggatgcggtttgccactcggtgcagggattggtgcattgctggtatgccacatcccagaagggtggtgcctcgaatgacgaacacgtgtggctctcaccagtcaactcatgccatgtggcatgttagttatgcttttagccggcggatgataaattaggtagtgtaatggtagcacagatatctcacagaaatgttaaataactagaggcaaaagtacaataggaagagatgtaaaggggagagaaaagtagatcctggacatttatttagagggcttgaacaggaacatggtatagccctctctcctgaaaaggcactttgcatcatcactttattcacttctttcctctcctctgcgtgccttttctagtggttggcagggcaattataggtgtcctgttctgcaaaaaccaatttgcagccaatgttcttacatgtcatcccttaacaggggaaaaatcacctataattctagcatttgttggaagtccatatgtaatttaaactagtcctcagcactcgggatgccagactagttgcttgctttcttgcacatcccccaacaagaaaactctctaccactgacatttgttgtggtgttatattaagattgcttctgtcatatttgacactagttccagcacttggcacgctgagaatagttcagatttaatgtttgcatgctcacacaaaaccccaccataagattcaaaaattagataaaattttcttctgctattactaatatgggttagatttcagattgaacaggtattcgaaggaaaagagggagaagaaggggacttgtgggattggtagatgagctgggtgctgccactggcattgctgaatgaatttcttcttcttatgcttttttgatcccaagaaacagaatggattcattctatctttacatttgctgtctttcataataaatggattaatttgctggtagatagcgtatagatcttagaatggcccagtttgaattatgtgaagatctcagaatgactcagtctgaattttgttacaaaggtcaaattttattttttatattttataactatgtagtggcttttgtttgatatggttaatatttccctgtttggagagtagtgcagggggttaccatccagctactcggtgctaagcagtatatttaccctttgtggctcaatattttagcatggatgagagtgtgaccttgtgtttactttttgctaatgttgaaccaattttagcttgtaatggagtttatgccactctcaacatattgtttccactgttgtgctacttggtatcaaaatcttgtgattagagatatgattatgatgttaagcacctaaaagtgcaacaatattgtttccattgtttgtggctcaatattgtttccactgcagaaagcaatatttttccactcttatcttgccttacaaatattatagaactttacattagtaatgtatgtggataccatctgtctacccattgctgagtagtaccttaccctttacaactcagtcttagcgagtaccatctggctacccattgctaagtaatacatttaccctttataggtcaatgttggagagcggataatagtgtgaccttatgcttttgttttttctaatgttgaccaattttagcttgtgatgatgtttatgcaactcccaagaaattgtctccactctgatggcacttagtgtcaaaatcccatgatcagagagataactaatacaacgcttagcactaaaagtgcaagctgcagaaaagtaatctcatctcattcttatttcatattacaaaaactataacatattaaattcgaattggtatttttgtcaggtaattgtttctggaaatcgacaatctttatatactaagatcgttgagagtgcaatggcatgaggacctgaagtaagttttctcctgttggtgattgttgtaattgctttattcattttaatttaaagcatgtggcacgcatgaacagagttgaacttttgcatggaccaagataagtagtcttgatatcaaatattgtagcatatgactataggttaagtatttaaacagcagctgaatacatttttttttttttaacgatgacttaagggggacatggttatgcctaatagtgagtcattggactgacagataagtgcttcttggttattgcatctgtaaatgttgttattttgattgaccttatgaaaataatagcagggtgcaagaatcttggcccagagtccgtgtaggtttgtgacaatggaaggttagtaaaatgaatttaaaaatgtgacgactgatgaggaacctgctacttattcattgttgggtgcattgctcagttatttcactcatacggaagtcaaaagctttcaatagcgtgcaccaagaacggatcagatgcttggagaattttttggagaattgtttcatgcacttgacataaattcgtgatgacagaaaatgcaggaaatgtggctgaataactaatatcagtggatattttttttcctaaggctgttatactagcatataagcctgcaaattagttaaagcaatactcgcgtaaaattcaaattaatttggatcaaattctcttagaatggacttattttatgtatcattagtagtggttagacctagattcactgtaccagtgagtactgccctgcaccatgggtatcggagtgagacttggtacaccccacgaactgacccctgtactggaacaccgtgcaagcgtgatgctggtatggggtcaagtaccaagattgcaaaccatgggttatattaatggtgttgtgctctagataataaagggtaaaagaaaatgactaaattttgaaacaacaaaatagactgaagcatgctggttaatatttttgctggaaaggtacatcttcatctattaagatcctgtttcacttcttttctgttttctcataccataattttgtatttgatctatgccaagctttcaaatcctccccccctctttctctcttgcttgcgcacacatacatacacgcattcacacacatatataatggttatgtcctctcacttggagagatgggtaccaaccagctgaggtactagccactgatgaatccactctcatattacactttcacaatactcagatatagatggttactgattctgaagatacctagttgcctatattgtctctgatttatatattattttaatgagtttttaacatgagtaggtagtaaacatggattttggcagaattttgcgaaaaaatcagttgtacataattcatttggaaagttcttggttatgatttaggaaatacaaatatatggatccctgctcatatttgatggcaaacagatatctggaaattgttgttttgtttatgtggctctgctaggaaataaaatggtatttgtgaggataaattagtgcaacgtattcttagtggatatgtatgtggctacgagatgtttcatgtgtgctgcatgtaaatgatgctttccagcagctactccatcctaatgaataggaccgtctaatataacttggcacattagcctataatgacagcacacactgagcttatcagagaagaggatatttagatggaaagtagtaaaatatatgtatggagaatacaaagcacgattaccggagatggtttgcagagctgtccatatgaaggcgtgatccaagcaaatttataagttgtcaacaatgaatttgaggagaacctttcagggacagagcatggccatatgtagaaatagaatcttcatttacaactcttaaagatatgcctgcctccaagttaactattgcttaaccactatcaccattggaatcaacattagatgtcattggatattactaatatgaccttgcattctatctttttctaaatagcatataaaaatgcttttctttggtttggggtcgtggtgggtggtgttacatatataaatgctttagatagtggtgggtggtgtgacatataaaaatgctttagatactattgttgtcatcgaagaaaaattagtggcccttattttttattaattcatgtggctagtcagaccttattttttctggactgccttccaacgtattttctcctttgatattcaatcctttgatgggcattccttttctaaatgagtgaattataattaagcagatgtttgcaatgtattcttggcaaaactccgataggccatgtaatcatgttgaattttgttcaagtgcatttcaggggccacatcaaccatttattatctattttgaacaagacccatccacattttttttaaatattttgaccttcagttcttgattttcctatccatctgtttatcaaatggctttttggcttttaaaaaaccagaaacaaattctttaagtctttaatgctgtaatttttgtaatgatgagtacatttaaatggaaccgtgtaaaattcctaccaatttggatcctctaatatgttctccctcataaactttccccttttggataccggggcacgcgaagatgcacgacggaaaggtgttcagataagttactcttttctcgcttgcattctctctttcaattagaccgtgtttaaatacctcctgcctgttaaagccgaaagatcttagcatgttcttcctggccattaacgaaagaatgagcaatcccctttgggcctaggaaggccaccagtcctctgcagctcagtaatgggaggcagaaccatatcatcttcccaccacctattttttcatcctatttactaataaggtgatcatatgcacgatgggtatatctctggaagccaaatggattatcagtttgatgtggagaaattggtcctattcatcagtattataatagtaaattgtagtaacagaactctacaaatgctgctcgtcaaatattatattgatcgttaatcaccatacaattagctttctaagaggctccccctggtaatatactggtgatattttgatgatattgaatatctggaattgtttgctttttaaagacaggatttgttgaagcttgatggtaagagtcatcatcctatactaaatctggctatatcatattagtcaaacaaaaaatggaaaaaaaaaatcctgtctgggctcctataatatataaatataaatgtgaatataagcacgcacgcacgtatatatgtatctatatatgcgtatgtatctacacacacatacatgtatatatatgcatatgtatctacacacatacatgtatatatatctatatatatgcatgtatctatatatgtatgtatgtatatatattatatatatatctatatatgtatgtatgtatgtagatatgtgtatgtgtatatgtatgtgtataaaatagtaaattgtaataacagaactctacaaatgttgctcgttaatcaccatacaattagctttctaagaggccccctggtaatatactggtgatattttgatgatattgaatatctggaattgtttgttttttaaagacaggatttgttgaagcttgatggtcagagtcatcatcctaaactatatccggctgtatgatgttattcaaacaaaaaatagaaaaagaaaatcctatctagacttatatatatatatatatatgtgtgtgtgtgtgtgtgtgtgtgttcttttttcctctcttgaataattttttgtgcaccgtatgcggtgcagcaaaaatgatgtggagtgtatcgcgatcgctgattgatctatgtagcatagagaaaatatcccttctagccatcaactcaacatctgacaccgcacttaataatgaaagctgcatgatttttcaatgctgcaaaaatttaatacagtagggcttaattttgaaaatttagaattgatcaaaatatctttttactccaaaacactttcagttgttctactttgttcaaatgatggctattttgaatgatattttttctttcttctacctcaattcgttctatttctatctgagcatcagatatctaagatttttctatagtgagccatgtacattcgaggttacattaatattttgcttgttctaactgtttcaagataatattttgtatccgtaagatttatttttttctctatagattttttttataaattcttaattactgctactccttaagtagttaaacagagttaatacgttggtagattgaaatggagttttttcctgttagtgcaataaggagtaataatatagttatagaaagccattaaaagcaaacaagatgtcataataactattagaaagttatataagccatcaagaaataatatagaagtttttttttggcatcctataacatccagatcaagaaatatgatatcttatctcttggtatgataccatatagtcttgaataactttttattttgtcaaatgagtgttttaaaggcataaatcacttcatatgaatttgtatgaatataaatgactctctattacttaataaagctatataaacattagctattgcttctttttcttaacaatattgttgaaatagagtttttttttgttggtgcaataggaagtaataatacagtcacgaaaatcataaaaaacaaatgagatattattaaagctataagaaaattatataaaccatcaagaagaaatatagaagtctttttttcatatcctattacattcagatcaataaatataacttcctatcttttgattggatatcatatagtcatgtataattttttattttgttaaatgaatattttagagatataaatctcttcatatgaacttgaatagatataaataactatctattgcttaataaaattgcataaataatagctatggcttcttgttcttaacagtattactgaaatagagtttttttttctgttggtataataaaaattaataatattgtcacagaaagtcataaaaagtaaatgaaatatcataaaaattatcaaaaaatcatataaatcatcaaaaagtaatataaagtcttcttcttgcatcctatgacattcggatcaagaaataagacatcttatctcttgtatgacatcatatagccttatatgacttcatattttatcaaataaatattttaaaggcataaatcacttcatataaatttgtataaatataaataatttttttattacttaataaaattacataaatattagctattgcttttttttaacaatattgctgcaatgaagttttttttattggtgcaacaaaaataataatactattatgagaagccataaaaaataaatgaaatattataaaagttattgaaaagtcatataagatatcaagaagtaatatagaagacttcttttcacatcttatgatatccagattaagaaatatgattttctatctcttgatttgatatcatacaattttgtatgacttcttattttgtcaaatgaatattttaaagatataaatcatttgatatgaacttgtatgaatataaattactcattacttaataaaattgtataaataatagttatagcttcttccctttaatagtattattgaaattgagcttttttttgttggtacaatagaaagtaataatactattacagaaagttataaaaaacaaataatgtgtcatgagagctatcgaaaagtcatataagctattaaaaaataatataattttttttttttgcatcctatgatatttggatcaaaaaatatgacttcctatctcttaatatgacatcatagtattgtataattttttattttatcaaataagtattttagagatataaatcactttataaaatataactttttatctcttggtttgacatcatatagtcttgtatggctttctattttatcaaatgagtattttagaggtatacattacttcatataaatttatatgaatgtaaatagttttgcattacttaataaaattatataaataatatttatagtttcttcttcttaacagtattgttgaaattgagctttttttgttggtgcaacagacgtattaatactatcacgaaaagtcataaaaagcaagcgagatatcatgagagctacaagaagtcatatatgccattaataagtaatatgcaagccttttttttcatattctatgacattcgggttaagaaatatgacttctgatctcttggtatgacatcatatagtcttgcatgattttctattttgtcaaataagtattttaaagatattagttacttcatataaatttgtatgaatataaatgacttctcattacttaataaaaatgtataaataatagctatgacttcttcttgttaacagtattgctgaaatgaaattttttttttattaatgcacagaaaataataatactattatggaaagtcataaaagcaaatgaaatgtcataagagctatcgagaagtcatataaaccatcaaaaagtaaaatagaagtcttcttttcgcatcctatcacattcggatcaagaaatttgactttctatatcttggtatgacatcatatagtcttgtataattttctatttcatcaaatgagtattttagaggcataaatcacttcatgtgaacttatataaatcattattgctttagcttcttcttaatgataggacatactgctagatgatattgctgaaataaaatttttcctattagcgcaacggaaactaatattgctgtcataggaagttataaagaagacatccggtggtccatcggttgaaaaaaatagtaaaagactagctaaaagataaatgacggctctccataaagtagtggaggtagtataacaaacaaatgaaatcgctcaatcctcctttgattattagatgagtttgatgctaaaatatgcagtcatttaatacatgaaagagcaaagaattaatatatatttgataaattttcatcaatttttattacaattttatcatttggagtaatattttatgatgtattattatgattttgtcatagtctgtaacacaatgtgatgttctgaatgtaatttgctatcaatttttatgatggcattcagtatttgttttatgagttctttattatataatacatcaataaaagcaatatgatatcctgaatatctatttcaatataatgctaaaatgaaataaatctgaatgaaaaaatacatgactatgatttctagaaaaaattatgacatcttatattgattatattagattcgaaaagtcaagtaatacagaaaaagtgtattatcaaagtaagtctttattgaaattaacttactaaattattataatatcttgttatatattataacatcctatttcatattataaatctataaaaaagatgtatgacatcctataataatatatgacttcgaaagaaaattatgatatcctttatatgctgtattacatctgctaagtcaaaaaaatagaaaaaattatattaaaataagtttttattgaaataagcctactaaattatcgtggcatcttgtaaaaattaataatctcatatagtcaaaatattatatatatatatatatatatatatatatatatttacttnnnnnnnnnnnnnnnnnnnnaaataattatatatatatatatatatatatatatatatatttaactttctgtattcactctcaaatattgtacaagaaaaaatattaaattatcatatttcacagtaatacattcagtaagattaattatattcaaaagaataattgcacttcattaaagattgtttgttacaatgcaataatcaaataaaaaataaaaaatattttatcaattataaagattttatttttttcaaatatttttaaaatttttaatagcagcattcactttctatgcgagctcctttaaaattctcgctttaatattacttcctattgtattaacaaaaaaaaatttatttcaacataccatccagtagtattcttatcgttaagaagaagcaataactattatttatatcattttattaagcaacgaagagtcattgatatttatataagtttatatgaaatggtatgtgcttttaaaatattaatgtgacaaaataaaaaatcatacaagattatatgatatcatatcaagagatagaaggtcatatttcttgatttgaatatcataagatgcaaaaaaaagatttctatattacttcttgatggcttatatgattttttgatggtcattataatattatgtttgctttttataatttttcatgatagtattattgctttctgttgcataaaaaaaatttcacttcagcataccattaagaagaagaagaagccatagctattattgatacagttttattaagtaatgagcagttatttatattcatacaaggtcatatgaagtgatatatatctctaaaatactcatttgataaaataaaaagtcatacaaggctatatgatgtcatatcaaaaagtagaaagtcatatttcttgatccagatgtcatagaatgtcaaaaaaagatttttaaattatttgttgattgcttatatgacttttcgatagctcttatgatatcctatttattttttatgacttttcataaccgtattattactttctgttgcaccaataaaaaaaaaagttttattttagcaatattgttaagaagaagaaccataactattatttatatagttttattaagcaatagagagtcgtttttatttatataagttcatataaagtgatttatatctttaaaatatttatttgacaaaatagaaagtcatacaaagttatatgatgtcaaatcaagagatagaaagtcatatttcttgatttgaatgtcatgagatgcgaaaagaatatattacttcttgatgatttatgtgatttttcgatagctctcatgatatctcgtttgctttttatgacttttcgtgatagtattattaattttatgacttttcgtgatagtattattaatttttgttgtatcaacaggaaaaaaagcttcattttagcaatactattaagaagaaaaagtcatagctattatttgtgcaattttattaagtaatggggggtaatttatattcatacaagttcatataaagtaatttatttctaaaatactcgtttgaaaaaataggaagtcatacaaaactatatgatgtcatattaaaagataagatgtcatatttcttgattcggatgtcataagatgcgaaggcttctgtattacttctttatggtttatatgactttctgatagctttcatgacatcccatttgctttttatgactttccgtgacggtattatactataaaaaaattgactattagcgatgactaaatgtcatctctaataacaaaaataccatcgttaataatattagcgatacaagttgtcgctaaaataccgtcggcaaaaagcacgacgttaaaactatgtattagcgacggtgaaaacatcgacgctaataactgatactagcgatggtggttagagataatattccgtcgcttacaatatttttaagattttaaattaaaaatttaaaaatcaattagtgatgacttctccatctctaataaaccgtcgtcaatactttttggcgatggaattgcctttgcgaattagcgacagaattatcattgcaacagccatcattcataataaattttttaaaaaataatttttagtaattatatatattaaaatttattataatttaattaagaagtaattatatttactaaaatctattatacttaaattaacaagcagcatatatttatagacattataacaattaacaattaactatcatcatcataaataaaaaattaatattatatattacaataaaattaaattgtataaataacactactcaaatattaaatacattacatcaaagctaaaaaaaatcaatggagatcctcctcctgcttctgtgcatctcctacagcagtaggtggatgaacatcagatgttttagcatcctataataaagaaaaataaaatattattaataattttagaactaaattaattgaaaccgtaaaactaaagtaattgatatgtctcaagcctaaatctttacagagagatatatttatatgtacgatacgattttcgaatggattattcctatatatttcatttgatgatacagagctatagacatcctcagctagtactccattagatggttaagttgaattttgaccttctgattatttttaccttctcgctggaagtctaaaccgacataaaagaatatatttcgatatgctcttttaattttcgaacggattgttcttacacgtttcattcgatgatatagagctataaacatctcggtccatccatcagatggttagattgaattttgatcctctaggtatccctccctttcatctcaagcctaaaccgatatggagggatattttttgatctttcgatttttgaacggattattgatacggacgtatctaacctccatcccatctatcgaatggatagattgacttttgaccctcagatccccttcttttgactcgaatctagatatgtgaagcttctaaatataaaaatttaaaataaataaaaaaatattaatactgcttgatttatctactatgatggtatgacaatgaactcaactgattgtgaagatgtgatcccagagaatctcaacaatcatatcgtgaatggcattctgaaagctctaagatcgttgataaaaaagactctacacgacctcctcaacatgtgcatcactccatatttgggtcatcgaggtctgagagaaggacatcgaaaaccagcaactgttggaggatcgaagctatgtccaaaccctatgacctagctcctactaactccttcgatggccctgagccatccttcgaagttaaggagggactgagaggacaggtcctcactgtgccgtgctacgatgtattacacataatctacctatgcagtttagaaattcattagtgctattatatatatcaatacatataaaaacttaataaataatcttttaagttaccgcgatccgtctggatctagaatctaagtaatcatcagtcctcctagattggtatgcagcctctcacaactgtagctgggatggtgcatgattcagctatcgtgtctataataaataataaaattaaattaataaaaataaatatatgatcaactaaatatgagattaatataagtatagaatttttatcaatctttctgctatgatattgtgctaatggagctgcagtgtgcttgatcaaattttgctaggcggttcgattctgtcgggccctctaccgtctattggagtacttctcattgcttcattggtcacaaagggcctccatatgtccccccacatctggtgatccgtgaaagactttcaatgcgatggtgactcgtaactggagaactcaatggtggactgcctgaggtggtatagtccatcccaaagttgatgtgtggtgacctcctcgaaggtccgacgaccagtctcctcatcttgaggagtttcaaattgatagtatgactgcaaataaaggatggcatgtattaataaatggaatacaaatatatcgtaaatttaaaaattaaacatctttaatttatcaagaatatctcccacacagcatcacgagcccttgacggtcaactagagaactcattcatcgatcctggcatcaatcgtcggacaatctcgataaccacacgagatacttcaggctccctaaatatcctgtaaaattgattttgaacaattaatgttgattttaaatggttaaaattttttaaacatattcctcgaagatctagtaattacatacagctctgaatgtgtactagctttctatcctctggtcgagtcggaggtgccgtgagcttgatggatcctctactacgacgttgaggctcagagctggccgctactctgtgtgactgtggggtcaatggagatcccacatcgtccaaacctgagagtagtaaaaggttatcaagaatattatattagataataaaaaataaaataatctaatagagaatttttatagtgttagattttatcccatggtgtgggtgctgcagaaccatatgagctggccgcacgagagctctctcttttggagctctatcctctggtactcaatccttggctattacggctccattctctataagtagtcatcctataatctctgcaaataaaaataaatagattcatggattaataattaaaatgatgcaaggcaagcatgaaaagtaaataaaacaagcataccacaaagataaaaatggctccatctgttctggggttgacttcaattattcaggagttgactccatctatcatggggtcgactcctactatgtgtcagtcttctccagtgtgtcagagttgactcttttatccttagagtcgacttttttcttcctcgggttgactactcatcttcttttccagatgtttggtacccttcagattcttcttccgattcctcctcttctttcacttcttcattttcttcttcttcttcatatttttggataggattgtcttttaaaataaactcagtataatctacctcttcatgtgggccatcatgtaggagaatttctggagcatccaactctatgtctattaaaggctgatgaactcttactgtttcatccttctgaaagtattctgataaatgagactctttttcttcgagctcataacgaacggctcgtgacttaattttacatacagtccagcaatctttctttcttctctctcttgatgaaaaataagtataatatatttgaacagcttgttgagctagcacaaaaaagtcattgatatatatttttattccatgtttgatttcaataagtctgtatcatgaatcaaccttcatacaattgatgttatcaaaccatcgatatttaaatagaatgatactattatcttcaaaatagatcaatttgatcacttcttcgaagattttatagtagtcactctccgtctttgcccatcagttgtcctatgtacacatatcgctgttcattatatttttatgatattcatattattggatgtgaaatttaaaactaattacgttacatccattataatgtgtcatgtattttattgatctataacctaatgatcttagcttttcaggtatggattcatctttttgcatgatctgcatattataaaaaaataaattaaaaaaaattaaaataaatgaaatgacaatggttgcttaccaattaatggaatcaatttgcaaagttcagtgaacgctgcgtgaaaattgattcctcgcttagcttcaaactgtcctgtcttagcatttcatcatattacctatacatgcataagataagtataggataataagtgattgaagagttgagattatgatggatacttaataaatggatcgatctcctcgcagtttagcaaaacatatgtctttgttctgtcgaatttcagtattaattaatatccgatgaacctcgtatccaaattcacgagcgagatagacatattgagatctccatctctgatccctcaccaccaccatcattttgatctacttgagtcagctttgtctacacactaggattaaagtagtatcgactgaaattagaaatttcttcaattatgtaagtctccacaatagaaccttcgattttagcattatttttcactttcttcttaagattgtacatgtatctttcaaatggatacatctacctatactacattgatccctcaatcctagcttcatagtcaaatgaatcacgaggtgctccacggagtcgaaaaaactaagagagaatatcttctccaacttacatatagtctttacactgctagcctcgagactggagatgtagtcagcggatagttcgatagcacaaatatcttgaaagaaaagactaagctcggtcaaagaatttcatatggggttgggaaaaagatcatgccaagtcaatgagagtaatcattatatgaagacatgacagttatgactctttaacccatagaacctgcaatctttgatattgacgcatcgagctagattatttgcataattatctgaaaatttaagatttttatactatttacatacgtacttcaactgctttcttattaaggtataagatgctttcggcttcaaaattttttctagagacacctcaaccagctctaatagatgatgcttacatatgttcttcatatttgttcaaaccttggggttgtccttcgtcttgccattgacatccataacagtatagaaaatattatcgaatacattcttttcaatatacatgacatcaaggttatgacggatcaaattgatggatcagtacggtaattttcagaatatgctgcgcttcatctagttatgagttctatcaaatcttcgagatttttgtttatcaaatagtatactaaactagacttctccagttgggatactctctgaaacactttcctaccactaagtcatgggggtgcctcatccttctttattttatttcttctgaaactgttttgttgctttcgaaaaggatgatgtttgaagaaaaattaacgatgacaatcgaaccagcaggacttacgatcatgctcaagttgaaatacttttatattctccatgcaatagggacatgctagcttctcatgagtgctccattctgatagcatcccataagtagaaaaatcactaatggcctatattaatatagcattcattacaaaattctacttcttcgatacatcaaaaatacgtatgccatcagatcataagaattttgactcattaagaagaggtcttagatatataccaatgcttctatcaggttatcatagttcaggaataattaatataaaaaagatgttatatttttttatacacatcctaggcggcagattatatgaagtaataaagattggctaacatgaatgaataagaagccgctgcatgactaagtagtgtaaactcatcggtagatagacccaatctgatattatgtgatcttgagcaaataaaggatggcaagcataaaatttcttctatgccttattgtctgatggatgagtcatcatatcagagtgcttacaaatttttttttgtatcatctcatctgttcgacagtactcttggataagtagagcctcctaagtctaagagtgaggaaaaggtatcgaagaaccttgtatgatatatctttttgattcctaccctcttgtcttggcttaaatcgcctttcatcgtatacatcacatgagcttttcaattgatcctctttatagaaaaatatgtaatcattacgacatacttctattttcttgtattccatgcctaacatttttatcattttttttaaagcatagaaactcccaacaaatttctcatctttctatagtatttttttatgattgctacaatcttatcataacaattaactatcatattatactcgaccttcaagttcaacaactttggcacagcagataatacagtgtgtatttcacattctaaccatagtgattcattaacatctctcagcatacgatagaaatcatcgctgtcagcttttggatcgtccttcacatcccaattaaattcagaaccagtaacatccataacaatatctaccattctatctatatttctatcctactcacttttaatccttgcaattgtctcccacatctcctcgtgcaagtaccaatgcttatagttgggcataaatccacttctatataaatggatagtcattgtatctctatcaagcatttctctattgccacatctcttacaagagcaatgagctcacttttgatgtaagagtgctgcattcctaaaagcatagtcacaaaataactctacaccctctttatattcagtagaaattatcctgtcgattactcgacggtccatacaactatggtctatagcacactatctaaagattttgcatatatgaatacaaggcaattgctaaatgattattttatcattttaaatgatttatataataattgcatcctatcatcaactaataggtataggagattttatctcgttcaagaattatattaattctataggtcaagtacagtaatcaaacgatatgcaataagggttgaaaaaaatttcgatagcatctccctttagttctctcccacatgacgtaagatgtgtgaggagaactaaaaaaaatactatccaaaatttttttcaaaccctcaccatactgtttgattagtataatgacatatagaattaattatatttttcaaactatccatactggataatcaattgactaatatacataattcttctattcgtacaaaaatatataaatatatggatgccgtagaatatgtatattaatcaaaagatagatttatggttctatacaatgtaatatttttaaaatttttaaattaagaattttcaaagcaccgagcaacattacaaatagggctagaaacaggttgggctgggtcaagccacgcccttccttgagcttggtccgaaattttttttcgagcttcagactgggcctaggctctagaatcttttaaaatatgagtctcaagtctggtctgaatctaagcggatcagtccatatcatttatgatggatcgaaagcaagctcatcatgtcgctgtccggatcttaccgatcatcttcgaagggcagatgttctccatcggaagcacattggtcaccgaagaattcatcgagatgctcccaccatcatcagagtagataagcgagtcagaggtggttcgatagtggctcgatctcgaacccctgctattgaaggcaggattattctcattggagagctctccagagtggttccacctcctgagagcaccactaaatacaatatttcatatggcagtggtgcttgctcagatcttatccgtaattgagaatgtgctttccatgcacaaattacatcaaatattataaatttaaataaattttataaatctaaatttaaatattaaaatttaaagatagatcagcgtgtggcaatagctccgtcgctgtctccgtcgctaatactcactaggtggcgcagggaagaagaggaggcgacgaggtattacggtacggtgttccggcggtgcagcaggggaagaagggggaggcggggatagtggatcccacgagaggaaggtcgatccgatgcggggatgatgtcaggggaagaagggggaggctaggaagaagggggaggctagggtgctgggatagtggctccgatgagcttccgattatgctaggaaaataagagggaggcacgggctcggggatgatcgattcgatgcgaggatgtcggatccgaggggatggcggcacaggggctcaagcgcagggatggggcctccgacgacacgaagggggaaaaatggtgacggaggcgagggattaagggggcggtggtggaaaatgaaacagagagattggggacagaggctatttttaaggcagactattagcgacagctagcttccatcgctaaagtcatcgctattactggttatttaaaatttaatttatagctacgatagtgctatcgctaataactaaataagtaataagtcttcgaccttttgacgataggatttgtttccatcgtaaaacatggtcggtaaatatttttattagtgacggtttttttgtcgtcactaaaagccgtcactaatactctatttttttgtagtgttattacttcctgttgcatcaataaaaaaaaattctatttcagcaatactgttaaaaaaaagaaactatagctattatttatacagttttattaagtaatggagagttatttatattcatacaagtttacatgaagtggtttatttctttaaaacactcatttgataaaatagaaagtaatacaagactatatgatgtcatatcaagagataaaaagtcatatttcttgatctgaatgtcataagatacgaaaagaagacttctatattacttcttgatgatttatatgatttttcgatagcttttatgatattctgtttgttttttatgactttttatggtaatattattacttccgattgtactaacagaaaaagcttcgttttagtaatactgttaagaagaaaaagttatagctattgtttatgtagttttattaagtaatggagagttatttatattcatacaagcttatatgaagtgatttatggctctagaacactcatttgacaaaataggaagtcatacaaggttatatgatgtcaaatcaagagatagaaagtcatatttttttatccgaatgctataggatgcataaaaaaaacttctatattacttctgattagtttatatgattttctgatagctctaatgatattttgtttgttttttatgactttttatgactgtattattacttttcattgcaccaacagaaaaaaaattctatttcaacaatattattaagaagaagaagccataactattatttatatagttttattaagtaatagagagtcatttatatttatacaagttcatatgtagtgatttatgcctttacaatacttatttgataaaatagaaagtcatacaagactatatgatgtcatatcaagagataagaagtcatatttcttgattcagatattatagaatataaaaaaaaaattatattattttttgatggcttatatgacttttcgatagctctcatgatatcccatttactttttatgacttttcgtgatagtattagtactttctattgcaccaacagaaaaaaaagctctatttcagtaatactattaagaagaaaaagtcatagctattatttatatagttttattaagtaataaaaagttatttatattcatacaagtttatatgaagtgatttatgtctctaaaatactcatttgataaaatagaaagtcatacaagattatatgatgtcattctaagaaataaaatgtcatatttcttgatccgaatatcatagtatacaaaaaaaaaatttatattattgtttgatggcttatatgactttttgatagctcttatgacatctagtttactttttataacttttcgtgatagtattattactttctgttgcaccaacaggaaaaaaaaaatcttttattttagcaatactgttaagaagaagaagtcatagctattatttatatagttttattaaataatgaagagttatttatattcattcaaattcatatgaggtgatttatgtttctaaaatacttatttgataaaataggaagtcatacaagattatatgatgtcaaatcaagagataggaagtcatattttttgatccgaatgtcataggatgcgaaaaaaagcttctatattacttcttgatggcttatataagttttcgatagctctcatgatattttatttactttttataactttctgtgacattattattactttctgttataccaacagaaaaaaaaaatttcatttcaacaatgctgttaagaagaaaaagcaatagctaatgtttatgcagttttattaagtaattgaaagtcatttatattcatacaagttaatatgaagtgatttatgtctttaaaacactcatttgacaaaataaaaagtcatacaaagctatatgatgttatatcaagagataagatgtcatattttttgatctaaatatcataagatgtaaaaaaaagcttttatattactttttgatggtttatatgacttttcgatagttattatgacatcctatttgcttttaataattttctatgactgtattattactttttgttgcactaatagaaaaaaagctcaatatcaacctaccaacatattaactctgtttaactggagttgcggttataaaggattctaaaaaaaaaaagatctattaaggaaaaaaataaactttacggatataaaatgttgtcttgaagcaattggaacaagtaaaatgttagtgtaattttggatgcatatggctcgctgtaaaaaaatcttggacatccgatgctccaatagaaatataacgaattgagaaagaagaaagagaaaataacattcaaaatgaccaccgtttgagtaaaatagggtatctgaaagtattttggagggaaagaatattttgatcagttttaaattttcaaaattaagtccaactacattaaatttttgcagcattgaaaaatctgacaactagagtaaaatccctatttccactttaaacttaaaagaaactcccccttccaatttaaaataaaagctactcccagtttgaaacttaaattaaaaggagctacccaaatacgctaaaattatcaaattatccttttgatacttaaatgggcacaaactcttttctcccttgccctggtcatccaacgtccatcgcacgccccccagactttcaacgagatcgcatgcctccctgcttcgccgctcgtcttcgatcattgattctctcaagttggtctactctctttcatccttactctgctccctcgatcccctcacattgttgttctccccactggtggccgcctccctctatcttgctgatcttctgtcggttgccgtctccttccatcacgtcgaagaagcatagtcttcactctcttgttggtacttctgtcttcctccattacgtcagaacaatgtccacgcccggaggtcggtgcaagaaatttcaaccggtaagcattgccccccaagttgaaattttagaaatagtttaattcaaatttttattgtttatgattgaatgagaaataattcaaattgcatattcaatgatgcctaattgatgcaagtgaaaggcaatttatacttcgttgtgcataatttatacaccgatctgcatatttagtattttcatactgtttcaggacttaggatccttaaataaaaaaagagagttatcttttttgctaaatattttcttatatattacatgtaatgccaagacctctactgcattgtgctacaggttcaaactaaatgtaagagggctgatttatttagcgggaggttggagagtagatgctctccaagttcattgtacagaatgttgaatgctaaagagaaagggaagaagagtataaaggagtcaatctcagatgcacaaatggagcttctacaaaaaacaccatttgcacacttccttgatataccaaagttatctactagtccaaattggttgcgtgtgctcatcaagctgttcgatgagcaaagaagtatattcattgtcagcaacggcttagagctaaaacttgaaaaggatgagctcgccacaatgcttggcctccctctcaccggcctaccagtagaacttgacgaggagggggcactcccaaaaggtaaaatatataataaattgcttgggggtttttaagatggggggcatagaaataatctcgaaaaactattaaatttttatgttggctctaaaagagagaaagaggtgaaagcttttatttttattttcgtgttggctgtgttgaacacgatacttttttccttgtctacaaaagggatgtcaagatttatacataaaatatattgaccatgttgacaagttgggtgagttcgactgggggacggctgtttatatatttttgatggagaacataatatccagtcgtcgagtgatacatgattgaaaaaataacacgaagccatcatccgattacttaaatgattgtgctatcggtttgttggtaagtatcaagtgtaattataatgtattaattttatattttataataaataattttataataacaataagcttgctaatatcttttattattatttgatacagaattggtttctagagagggttccctccatcttgacacccctaggtgatagggcagcaaggccccgtctcttcaagtgaaaagtgaaatggttaaaatgtattaataaaattgaagaaaagatcaatgggattaccactgataaggtaatattgtcatatgttatttggtactgaacatctctgatatcatactgccttatgatataataatactacattattgatactttatactttcatcagatcaaagagtatcagtttgccccattcgagcataagtacctcagtggaatatctattggtgcaagtgtttttcaggtgtatgctgatagggctgccactgttgagagaaagaaaagaaaaaagaaacaaatggatgttgctggcacatcttatagtgtggattttcagagtcttgtacagagggttgagatgcttgaacaaagcaataagaagaaagaagatgagatcttgaccttgaaaacaaagatcaagttattaaagagaaattgtaaaaaattttgtcggattttggaaaggaataatcgtggagcgatattttatggttttgactcatccaactctgagtctaaatcatatgcatcctcatctgacaatgaggatgacaatgatggtaaatccaagaaaaaagttgaggaagaagaggaagaagaagaagaagaagagaaagtaggaggaggaggaggagaagggacaaagaacgatgagaagaatgagggacaggaagaaaaagaggaggcaaagaagggaaagaaaaaggagaaagaagaggaggaggagggggaagatgagagtaagaatgatgatcatgaccttggtggaagttatgggggtaatgaggatggcaacactgaggaggaaaacaaggatggagggcttctttaattgtcaagaggttgaaggagagggtggataggaagtcaatattaaccaagatggtgaaagattatcttgttggcaccgagtacaaaaggaggcgcaagaatcctacgacaaccattgatgttcctagtgataaagtaaacatttgccaatatattttctgatactaactgtagtagttttatatatttctgactccattatatgatacttctctataccatattgatactgctttataatcatttcatactttcttttagctatttgatatattttagtgctatgcgatactttcttggttctagtttttctgttactgctatgatagttttttgatacttctttggttctacattgatactattttgtagttatttgacattttaattaaattatctaatattttttgagtactaattgatacttcgttgtatacagaatgttgccatagtagatgctagtatggctcaagatagtaggtatgagtgtatggttgtaaggttttatgccaatgataggtatattcgaaattattacttttctctagtacttgtaagtgaattattattatttttagggatcttatttggaaggaggataccacatatggttctatatgggctgaagacttgagcctacgtaaattattatcttcaaagataatatttaatgatgtaagttgaattatattataggataataatattgtaaagtttttcttttaaagtttatgaattctatttgtatgaatgaacagataattaattattagatgcgtataatagaaatcttgcccaatgaagaaagctccaatagataatgcaacatctcctacctacgcatggagtctatggtatgaattgtctatattttttattttcagtatcacatctaagctttataaaatgatattgagctgctaacatatttttctttctaattattggcagcatgagatgttaaactatttctggagactaggtgaacatccagataaaggtgctatggaaaaaatcatagggggcatgagaaacaccacgcgtttatcttttaatcatatttctctttacattcttgccacatgtcgctacataatgcttccactcaacaccactgataagtgatactggcaccttttggtatttgataccatacgtagaaaatttttgtattatgactctataaaaagttcaatagcaaaaaaaaactgtcgaaactattgtaagtataaaatgtcaatttcattaatcagtctttgatgtttatggcaattttgataagtggcactggcatcttttgatatttatgacaattcgctggtcgggttgctcttgctcgcttattttatggtgctgtatcattttatcccatgggatgtatcaagccatgttgatatcgatagaagttggttggatttttcttgctgtatcactctgttcatggcaattcgctggttcgatactaacaaatataaaatgatttgacatagatgagcttcttcggactatggttgaaacattgtcgggatattgtacttgaagactactttgtggaacatatatcagattgttgagatcaagatggagacattaattatggggtctatgtttgcctatgggttgagttcttcaagagtaatgaggaattttggacagcggcgaggacttgtagcatggactgatacaggactcatatggcataccatattttgatggatcacagaagcactcaaaaggagggtattaagaaatacatagctgagcgatataaggattaagtattattttattgtcaaatattttggacatttgatgtatgacatgttcttttggatatgtggtactaccaaaatattgcaattctatgacatgttcttttggatatgtgatactatgacaggatttaatttttgatgaacttgaaaaaatattgcttaataatattaaagtatcaatttggtgtaacaaaatatcgattaataatattaaagtattgtttaatatcattgcggtattatggcgagcataccatacttccatataataataccttcaagtactttgttcgattaagtaagctctcataaagttgccttgttctctcatattcacctcctgatatctcatacttgtagtcaatgcaagccttgcacaatagttctggcatgtccaatgtaggtagagcgatcgcaagtttaaatattattcgagcacgctctatctcacctaatgatcttttcaatttggcatacttgttcaaagtacaataaagtgttgcttaataatattaaagtatcagtttgacataacaaagtatcgattaataatattaaagtattgtttaatatcagtgcggtactgtggcgagcataccatacttccacataacaatatcttcaagtattttgttcgatcaagtaagctctcataaagttatcttgttctctcgtattcatcccctgatatctcagactcgcagtcaatataagccttgcacaataactctggcatatccaatgtaggttgagcgatcgcaagtttaaatattgctcaagcatgctctatctcacctaatgatctttccaattcggcatacttgttcaaagcacaataaagtattgctcaataacattaaagtatcaatttgacgtaacaaagtatcgattaataatattaaagtattgtttaatatcaatacggtactatggcgagcataccatacttccacataacaatactttcaagtattttgttcgatcaagtaagctcttataaagttgtcttgttctctcgtattcatctcctgatatctcgtactcatagtcaatacaagccttgcacaatagctctggcatgtctaatgtaggttgagtgatcgtaagttcaaatattgctcgaacacactttatctcacctaatgatctttctaattcgacatacttgttcaaagcataataaagtattatttaataacattaaagtatcagtttgacgtaacaaagtattgattaataatattaaaatattatttaatatcagtgcggtactgtgacgagcataccatacttccacataacaataccttcaagtgctttgttcgatcaagtaagctctcataaagttgtcttgttctctcgtattcatcccttgatatctcgtacttgtagtcaatacaagccttgcacaacagctctagcatatccaatataggttgagcgatcgcaagttcaaatattgttcgagcacactctatctcacctaatgaccttttcaatttggcatacttgttcaaagcacaataaagtgttgcttaataacattaaagtatcaatttggcgtaacaaagtatcgattaataatattaaagtattatttaatatcagtgcagtactgtggcgagcatacgatacttccacataacaataccttcaagtgctttattcgatcaagtaagctctcataaagttgttttgttctctcatattcaccctctgatatctcgtactcgtagtcaatacaaaccttgtgcaacagctctgacatgtccaatgtagattgagcgatcacaagttcaaatattgctcgaacacgctctatctcatctaatgatcttttcaattcggcatacttgttcaaagtacaataaagtattgcttaataacattaaagtatcgatttgacgtaataaagtattgattaataagattaaagtattgtttaatattaatgtagtattatggtgagcataccatacttccacataacaatgatgtatccagagccccacaacccacctcttcatcttccataccaactgaagcctcaaacttggcataactaatccatgcctacaagtgctttgttcgatcaagtaacctctcatagacttggctttgttctctcgtattcaccccctgatatctcgtgctcatagtcaatacaagcattgcacaacagctctggcatgtccaatatagtttgagcgagtgcaagttcaaatattgctcgagcacgctctatctcacttaataattttttcaattcgacatacttgttcaaagcataataaagtattgtttaataacattaaagtatcgatttggcgtaataaagcatcgattaataagattaaagtattgtttaataccaatgcagtattgtggcgagcataccatacttccatataacaatgatgtatctggagccccacaacccacctcttcatctttcataccaactgaagcctcaaatttggtataactaatccatactttcaagtactttgttcgatcaagtaacctctcatagatttgcctcgtctcttgtattcatccccctgatnnnnnnnnnnnnnnnnnnnncttcatctttcataccaactgaagcctcaaatttggtataactaatccatactttcaagtactttgttcgatcaagtaacctctcatagatttgccttgtctcttgtattcatcccctgatatctcgtagtcaatgcaagccttgcacaacagctttggcatgtccaatgtaggttgagcgatcgcaagttcaaatattgctcgagcacgctctatctcacttaatgatattttcaattcggcatatttattcaaagcacaataaagtgttgcttaataacattaaagtatcggtttgacgtaataaagtatcgattaataagattaaaatattatttaatactagtactgtattgtgacgagcataccatactttcatataataatgatatatccggagccccccaacccacctcttcatcttccataccaactaaagcctcaaacctgacatgactaaagtagggagttgctttatcatagtgcattgcagtattgttttattatggcacagtattagtttagcataataaagtgttgctttatcatattaaagtattgacttaatacatagtgcaaaagctgcattcataaggtgattctagccctctttgttgtcttgtacactcttgacgtcctgcccctcttcagtatattatgctcattgtggttgtaggataatggagtactgaaagaaaatatcgaccatattagacaaataaggcaaataaagcaataactaaaggtcttcacacaaaatgataaataattcactaagacagatcaacataatattataaaataaggcaacaacataatattataaaataaggaaacaacataatatcaaatgccttcattgcagtatattaagcaaatacattttggaagcctcaagtgctttacaaaaaaacacagtatccaaaagtaacacagtatcagaacaaaagcttcaagctcaaaaaatgacccatcaataacctaaaaaataacacagtaacaaaggacagattaataacctagaacacagaacaaagtaacaaaggacagtaacaaagagcaaagtaatacagcatccaaaaagatagtatcaataacccaaaaaaagatccatcaataaaacaaaagcttgaagctcctaagagattctcttcgtgcatgtgcgtcgattgtggtcagtttggtgacaacgcgtgcacttattcggatgcgtgtcaacttgagatggaaaccttctagtcctaggatggtctgttcgtggtgcaatcacgggtggcatgatattgatcacttacactaagaaggcagcagatagcatctcaatcgtggggacataattgatgatttctctatatgctagttggtgcatctccacggtaaagaattcattacaataagagtggagagtgtcatccttttccttaatgaatacacaagcatgcttgcaagagatcattttcaattgccattgcttgcaagcgtatgttctatcagataaattaactgcatatctttctttcccatccaacacctcatatcttgttctactcgctacatgaaggcttaaggtgtggccctctcgatggttcttttgaagcctcctctattgcctaggttaaaagacttaaggtgaggtcctcttttgaaccttgcagctaagatccatcggttaaaagactctgtcaagttgttgtccatcactccccacctacaatcttgaaaaaatatattagcccattgtgcaggctgagtactcaagatctagtctctggccaatggcatcttggagactatatcataaaagtgccattcgaactccattcatgttgtagcatacgcgagagacttaaaaactgcgcaccaatattttttgtgtaatgctgaatatttggtcaatacctgaaagtggtaccagcaagcgtatattagaaatatctgccacgtgccaatgatgcatgtcattttctatcatacagtactaagtataccaataaagtattcagaacaccctaaggacttataacgaacttatattgtggtactaaatatatttttgatgtaccaatagtgtgtaacattttctatgtgcatataataaagtatccagaacacctaaggatatatccataattgcttttgtagtactaaatgaatataataaagtatccagaacatctaaggacgtatcaataacttacattgtagtactaactgaatacaataaaatatccagaacatctgaagacgtatcaataactgattttgcagtactaagtgaatacaataaagtatccagaatacctaaggacgtatcaataacttataaaatagtactaaattcatctcctatgttccaatggtgtgtgtcattttctattgtacagtactaaattctgatgtcaattcttcctctacactactagagggtatgaaagatatctagtgcactatagaatagtgagtacctactttctaaaattatctacaagatatcgtaggcaataagtatggtgacaattcgaaaatcagtcctcgaccgttttgatacatccaggttgacggtcagagtaaaaagtgtattgcttgatcaataagccattcgagtaggagagaacacatcatagctttcgacaaaaccatcaccagctctcgtcattttcttgttggacgatggcgaaggcgatggtaaaaatatcattgttcgcatcttttgcggtggcctcaagaggcatccttggtatttatgtttgatgtgggtgccatccataaaaatcataggcttacatccagcatgaaatcccatgatgcacgctccaaggctgatgaaaatacgacggaatcttcttgtatcatcaaaaatctcatagtctgcgatggtgcctgggtttgttaatttgagggctctacaataaggcttaagcttatcatacgacagttgatcgagatcatgaatctcacacatagtcatttccttcccatgccatgcttgatagtacttgagcaacatgccataattttcatggatatcggccacaattttgataggccggtagcgaggtatggatcttaactttgtcttgactttctcagcaacccaagaaaatgtgactttaggatgactcttagtaccgagaccattgtcacatgtgtgcatgaggttacactttctaatagagaatgtctcctttatttttgattcagcagcatagacacgccaagggcaacattccattgggcacttaactatagtattcatagaatcattcttcttgaagatatagtcacgattgtgtgcgatgcaataatctttaatagctgccctaaagtgttgagcattgcaaaactgctgatgctctcctttgatcaacccccttcatgtaattattgtctcgacaccaatgacattatcattgggatcatccaaattgtcataattctcatatccaattggtgccaacctattcgaaaaaatgacggaataataattgtgagtaccacttgtgctcatttttagcattctaaaataatttacatctttttaatcaagaggattacaaaaagttcatgatagatttgtagtatagaaaaaactaattacagtatcaaaagtaaataatatagtataaaaaaagcaaaatggagtatcagaactaaataatgtagtaccaaaaaggtacatcatagtatcaaaagcgactaatgtataattaacaagggtaatgcaatgatgtatgatttcatatttttatcacggtggtatatcatttcatatttctgctgtatcgataatttatactatagtaccatatgatgtaacatgaaaccacagcatagaagggcagatgggagtatcttgatgtgcctatcccttgatcctctctagcatcctctctcggctggatcttgctctctaaaactatatcgatgacctccttctttattacgtagtggatatgatacatgctagccacattgttatccttaagtaaaccatttgcatcattgtgaaaggtgtaaggtacttcacgatgaccatttcaagtgttatatggctccatctgcgtgagagaatgttgtagatgtccgagagcttcatcaatttagttatgccaaagacatgacaagtattgtactcgcaaatgatggagagttcagcatccgtacttgtgttaacgcagaagatgaagccattggagttcagggcacaggtgttgagggttggtcaaggatctttgggatttaaggtgtgggatccttacagtatagatgttgagggctgtgaagagaggcgagagagaagggcgagtagagaagagagtggaggaagagcacaaactgagtagagaagggaaagggccaagagcacaactgcctcctcttttaggcgggaagaaaacggagggagtagagaagggagggggccaaaagcgcagctgcatcctctttttggtaggaagtagacggagggaggtaagaactgtggagtagagaatgataaaatttttggcaggaaaaacatgactgaacgaaaaaaggaaaagaatatactattacccatagaaagggtataagtgtaattttttttctatggataatttttttttaacttatatttttaatagagagtagtttttatttaaaaatcaaaaaaatattttttaattttaaaatgaaacaaaaatttttctctaattttttttaaaaaaattatacagctttcattgttaagtatagtattagatgcagagttgtggtacatgaatcaatcaggcatctgaggtgtgctccacatcattcttgctgcagcatacggtgcacaaagaattactcttcctccctttaatgcgttcctgttactaaaaaaaaaaaaaggccaactcttatccaaaaacgaaaaaaaaaagaaaaaaagaaagaccaaccatgagatgatctaaggctacagctgatcgaacgtcaggcccggctctacggtataagtttgatctgatgtttatgctcaggtacggtcaaatccggacatcaggtctctatttttggtccagaactgatacggtacaatcctgaaaggtcaatatcaaaccctcccagcagacttgattttgacatattcactagcatagcatacatcattatgagattttattattctcgtccccacgcttattttgtgctcccaaatccgtcaaatttcggctgggcggtcaggctcatgatagatggacagacggtgccatccaattctgggttggtcagccttctccgtacagaagcttctagattcacctaccccagaccgcaaagcattgctttggatctaagataggtaccgcttaataactcagttttcgtcgattcaatatttacatatggtatcactttattctatttttataggaaggcagcatatgaaatccaaaaatacaacaagttcggtgggatctcagcatcagggggaagggatgtctgatttggtcagggcttcccaatccctccatggcgttctggacgatcttggaagctggtcctgtttccatgatttcctccttcaggtaccgtattctgccactgcttctgtcatgtcctttctattagcttataagatataacggagtctggaccatggaggaagttaatcaggtagaattctgtcttaattgtttcattgaccaagattgcaagcgtctggactgtcctctggtagattggtgggtttgtcttggttgcagtagttgctgaacggtactcctttttgtggtttgaccgtttgagaccaagcttaatcagtagtccaggtcggtgtctgaccatggctaatgtgtttccacctttgatgggtctcaaagttgggctgattaagacatttatcatataaaagccaacggaaacctgacggaacaaattctaagcccaaacaaaaccagccatatgtgtcacagtcatgtgtgcgcagtgaatagtgactcaatccaaccaccagccctggtcctaagcaagatgagagggacctaacacctgttcaccaacttcagatccagggcatgagaatatattacgatccctcgactttctcgtaccaaacctgtaccaaaacgtgagaagggaatggtttcatacggaaatcttaaagtgcaccgattccctaccaaagatgtttaccaggtatgagcaataaaatgagaaaaaaaatgttataaccgtccaaacagaaatcaacaatacttgttggttagtgatttaccaaccggttagccattttgattttatcgtaattatcttcaagtacaggactcgcagcggacgtgccgtgctgcgctgctcggccccggcggagccagcccaaccctcccgccgccgtgcgcatgggacgcgcctcccgaccatccccgtttgccatgctcaataataggagcactgattttttttttttttttcttttcttcgtttgttatttttcttccgggtcatgttcttcccttacccctgtttaggcgttaacccccttcccatctctttgttttattgttcccttgttaccctgaccgtagtcattttctgtaacattgttttactcacacgcatgcatgcacacacgtgcgtgcacgcagagagagaataatttgatttcgatagattccatgcgacttgtatgggaggatctttagctccgaggttccctccaagcacctcccaaccaatgccgaatctatcctacatccttctatcctccatcaaaatccctttggacttgagatatcgactgagagacaaccacgtatctacggttaagacttgggcagtggttcgcctcctaagaacgaccgaaatgctgtccttggctgaaacgggcaccacatgcccggctcctctcactgcggcaagcgtcaacctttcataaacctcagtagtctatcccccgaccttcacaaaacgtagaaaatgcaaaaattaaaaagtaaaaataaaaacacatactcccttcatcgactcaaatcaaaccaacgctcaaattaaccaccatcaaccaataggcctgccgatcaattatatacctgtctacctgtgtccgtggatacaatgggatattaaccgtcagattaacataattgattgagaacttcatggttctcactagaccactgaatccatgtctaggttaccatttaaatcactaaaaatcacaacatcaaatggctggaagaaaagtaggcagcacggcaaacttcgagtcaccccatgtctcgatcagcaattcaccacccagaaacgatcaaacaaggtcatcaacgtgcccccatccaaatgcgctaacgcacatgcattatctcatgcatgtatatgagaaatttggggttgatcaggtttcaacttaagctgcatacagttcatttgtagggaaagtcctgtagtgtttgtatgcatggccctggctcgtcaggctggttgtagtagatctcagcatacttctcggtgcatggatcatagccatatgatcggcagcaagttagggtgtttcagatcctagatgatcggagtggctgcggagctgggggccaggagtctagatgctgtactgatctatgtcaccaaactcataattcatggcatggttgatgatgctatcataacggcgtgaatttttggtggaggtgaagttatagtatgaaaggatggattggtaggtccgatcagagatcacggagtgactccaccggtaggacactgacactgcgccggtgctatcataatagttgtcagtgacatcattccccacctgtgcatcagaaaacggtgtgtgaggcacatatccggtacagtttatgaattttggttaaaaattgatgaaagaattcaggagatgaactgacagcacgtgtgtaggcactgaattcatccaagtctccatcctccatgccagactctggagatacttcatcaacattcttgttcatctgatatccatagtggctaagcatggaatatttgtgattggcccctctatgggtaatgatgattcaagatctccaaacaactaaacctccggtttttctctgggaataacagtcaatcgtaagtagaggaacacagcatggtttttaatttggaatagagtggtaaactaatttataaattgatatagatgcataattgctacctcaaagaaagtagtacatgaagcagggatcaattggcatgcggagactattgcggagtcggcatcaattggcacataccatccaactaccaaaatggatagatagcaaagatcaccctgtttaactggtgttactacactttcaagaactggtttgcagcaattaggtagacagcttatcctggatgtaagaaagtgtattcattcaatggtacaaagctagatgaggcaatgaacacactcttcttccaaggattggagggtatgaactacttaatgccagcacaggatcagaagaacctggctcttgatctaagagttcctggtaaacaacaaccagttgcttcatttacaaagcagcagacacctggtatcgacgttccttatagggatgaatatccaacaaggttgcatttcaaacgcaaggaatgtgcacttcctgacaacacaccactaggagatggatatccatatagtgtgagccttctacctgtgtttttggctgcggtatggtgtttgcaatgataaatgataactttctgactagttattaggaagacagctagtatttgtcaatatgaagagaccatattccaaaatagtccttcttaaatcttaatgcagccaaagccaagaattttccttttaagtttttattaaaactaaagaattctccaaatatttcctcttcttcttaagtggtacatgctgcaatgatttgaaataatggtaatttacaatgttttgtgtatacaatgagttgagacgaatacaacaccgacgtattaatattcttacaagttgtaagctcaactccaaaacatttctggagtgacgtttctttgtttgtacaagaaaatcagattggggcctaaaaaataatgtatatgaaagcacatccattaccagatcattgagcaagttattttatattattcaactgatagaaagaaaaatgagcccttaggagcactattttacattggacgctatgttttcttggcctgcatacataaagagagaaggcggtaagataaattagcttatcatacccaaataaacagaatgagacagaacgctatcatcaaagacaatcaattaacataaaaatgtaaagcaaaatccttacctttttcagatatttcttgtgaagtttcattgctccactgcatgctttttttgcatctaaatttccagttatgtcatttaaaatctaaaagtgaaataaatagataaggtaagattaagtcactgggcacgggtgtgtgtctgtgtgtgtgcgagagagagagagagagagagagagagagagagagacaatatctacaactatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngagagagagagagagagagagagagagagagagagcaatatctcaacatttgattatatctataaataaaattgcacattaaaatattgccctgaaaaatgcatcacaaaattttatgtaacaaaatagtaaattaaataatacagagactgaacttcatcctgtctatttgtggtttgctttatgaatccaatagtagtttgtgtccttgacatacatctcataatatctgagacctcttagatattagtccaaaaatatttaccatttgcatttcatgagttatattaaataatacattgacaaaacagcatcctgtatatttgtggtctgctttatgaatccaatagtggtttgtgtcctagaaatatatctcatagtatccgagaactcttagatattaatccaaaacatatttattatttacatttcataagcacaaataatcaaacggtcgcatgcttttgcatccttcagtgacagaaaggtacctagatattctgtccaagctagttttaaaggacatactttcttgcagaagcagggttgtgtttattgtttgcaagcaatcatttttatttacttaggtctagatatacctgtcaattatatcacggaatatgtacacatcatcataaaaagcctagcttggtttttaccttaacaacatcatccaagccgcgtgcttcctgcatcagagcacttttgtccttgagaacactggcaacaagaaaaactgtaatggggagtggggcttcagaacttttgcatccatttttcatattctctcgctcgtacttcccaaactggcgtgtcgactttactttccctttagatccctcatttttctcagtggcaacccctggttcttcatacatggagaagatatcagggtcatattccagagcccacatcatctgtagagaagttggaagataaagcatcagcttagcatacactggaaatacaatgtacaaagaaaaaaaggtggcaaaatgttttttgtgcttgtgtcaatagacaaatcctcatgaagcctatgagaggtatggtggcacaaagcaaaaatctcagttaaatttttgaggtttaatggtgttctatcagtatgccctcatgcaccatttattttctgcacaagacaccattgtcattgtttcagacatttctgtgccttccttgaccaattaaagcaaccttcttcaaacattttaagtatacaagaatcaagtacgtaaattaatgccaaaatatggagatacattgattacatgcatgcatccaatcataaatcaagagataatgatctttctttgaaagcagaacttctggaacgtgtctggtaacaagggccaagtattctgaggcatatgttagtgaagtaccacataagcattatggcaatagcaaatctagaataattgactgaaacttgaaataatgtactggccattcaggtccatatgaatttcatacctcccaaaggtacaacgagtctccaaacgacaactcccggcggaacaataccataaacatacggaatgcaaagagatagtcacctccacctagtgtttctgtactcaaaaaccaatacaatatgttagcacctgtctataaaaaaagagttgctatctattttacaagcataatcaacaagccacaatgttgaaacttgaaacaaggatggtacccaaaaaaaaaaaacacaacaattagcatttgaaaagcagagctaaagaattccaaaagctgaaagatgaccaagacattcatacagggcaggcaattttcccgaagatctaccgagtataattgaagctccatggaccatgattggtaccaccaaacagttttctccatttgagaatgaacaagtatagatacagtaattctttataaaaatgaaaaaaaaggattatagaaaaacaaatataacaaaacaaaatatgactgaaaaaaagctggaggacaagaaaaaagaactaaagaaaatatgttgctataagggctggttctcgatctagaacaactgactctagtacgggtgcttgctttgcataagttttattatctgataaacaaagttaaatttttaattataaagcagatgatacataatcacataaattgaaaatatacctaggtgttgatgaagctttgggtcaagaacttgagtgatggatgctagaatttgaagttggttctctactccaacagatttctcagtgcatctgaaatttcctcgctttaaaataaaaaaaatcaatatatcaggaaaaatccattacaatatgtggcacttttatcatccaataatgatgatgcactagtacatgaaaacagacaatgagaataagcttacagaatcttggatctacaaaagaatagttaaaatagtcagagaaagaaattacaggaaaatttattatgaaaattatgcaattaattctaccaacatgaatcactcaacatttcaaaagcactacaaatcagaattggaagggaccatattttcaaagttctcatatgattatcttgttatccagtgcatgagaggtactcacagtggctaacctgacatgcagaatccagtaatcattaaataggggaatccacgggcctggtcatggtgggccttggctaactcaggtgtcaaccttgaggcccaaaggacaaaccaaacccgaaattctgaaggagccaggctcaggcatgacccatcccactcatttaatatcccaaaaaattcgagtctattgagggatatgttgttaacttcttgtatacgtagaaaatcatcttttttgctctccatttaccaattctaaaggaaaataaggattaagcttgacaaagtaaacaattaaaagcagtattacataaataatcctacgaggtttgatgtttgatgtaaagactttaggaatgagctcctgttgactttgagaaatttacccatagaaagagatgcatgcttatcaatataaaagggtgtctatgtaggagatccttatctattaatatttaatgcatttttctggaaatctcaatggctgattgtgcccaactgcggcagttgggtggttgggcaccgcaacccggcttccggtttgtcctgcatcaccggttctacttaccaaaaatggcctacttggagctcttgattctgtggtatggctcaatggagcagccacaccgtcccacctatttaaagtttgagacttcatgaaacaaaccacagtatcagctgtggcccaaatggtgagtactgggtactaagccgatattaagcccagcctggagtgggtcaggtctgtagagcttaatggattagcctggactatggacaacctgtccttaagtgttaaaaggaacataagtcaccagattttagcaccagaactttgaagagagcagattagcaatataacctttccccaaagagcatcttgctgaaaagcaagcaatatacagacagattcataatttcacaaaatctaggcatgatcaatgacttaaaaacctgtaacatgcttgaaatgatccttgaaattaatagcaatttagacctctagtagcaccggagtgaattagagccaatattttccttcaatcagtttctttaaaaaaaaatatgaaaagacccatgtgtacatttctttatttaggctgatgttgtgagaactgataatttccctccaacaacatggatggtggaacagaattatcctcaatcacaacatttcatattgattttcatatcctgtcttgcttaccaatctattggctatcactgtcttcaggccattcgtactcttcatcagatcttcctgtaaatccatgctgcgatctgacatctctcatccccaatgtcatgagagtgctcatattattatgtttctcaagattctactctcccaaagtgggtttgatgtaaaacttgagtaagctcaggaggagcatcctgagaagttgaggcgtcattttgggctgcagaaaagctcaacggaacaaagtttgtgctgttgaggctctactttatcatatcaagggagctttcaagcttagctctagcaccatataggtcttgcacactcttacttgactttcctgcacaaatttgagcagtccttgctgagcctgactccaactttggagcacaagcctgcaccatctcaaactattcttcatcaaccatcactttatcctcaatcagtgcaactcctaatcctactttatagtatttcatcaccccttacttcctaattttaccacatataaacaatcttaactttgctacattcattttgtttgcttaggccacctttgtttgttctcctaaatattttcctaaaaagtctttttttttttgggtgaaaggagggatgaagactcaaagacaggaattcaagaagaggaaatagtctaagcagtgattgctaattttgttcccacttcctcaaaactagtggaagtattagaatttcagaggatcattccgtaataaggaaaaggatgtggtgcataactgagtcaagggatgttctcttctcaaggaagatctggttgtttctctctccaaatgccagtggataacagaattccctaataagccaccaaagcattcttccattgcttaatgacctaaatcacctctaccttcactcagccaactctacagaggggatcaacaaaagaaaatttcaaaagaagatttaaacctgaaaaaggatgagaatatttgagacttgagtggatgcctataactctgagaagagggtgtcaggaactgaaacctttgaaaagacataggagatgctcaatagaaagaaaatgaagagatgaggatgttggatgaagaagtacaatgaaaacaacagagcattattgagaggggctcagatttgtttggaggacttaaaagaaaagtggagtttctgaaaggcaaaaaagaaaagaaggatggattgaaatgaagggctacgaagccacatataaatgctgttgataagaaagaatgacaataggatttctaagccacctctaaaattaacagttaagggagatatgtttatgatcatttcaagaaatgtagcaaactagataacaatagtagaacacctctattatctaactgattaaagggcaatacataaataaaatggtaactgttaaataaaatgtttgataataaatgacctgctagcagatgagtttcaggctctttgctttagctaaactgttaaggacaggacaactagcccagaagcatgaaacacgtcaaccagtctatggttgcaagatatgaggctaaattgtaagcagaaaagctccacaacatcaattaaagaaatggaattttgaactgagaaataaagtagacaaaacaaaatacactcacttgccttgttattatcctattcttgattcttaagtgctaataggaaaaaaaaactagggtagtcacctcctgcatgatgtagatttatgaccataagcatgacagtgtcacatttttctaacagacatccagagtggctgtttgaccatcttaaaggaagaagagatgcatggcaggacatgtccaaagctgccatgtactccttcaagataagtcaacttacagaaggaaatatcactaacccagaacataaaggtatctagaagtaacttttaaagaaatctaggaatggctcaaaaggatcaattagtaaaacaacaggtagcttgataaagactataccagtctgcgcatcaagcgctcaaagcaccaaaaagcatctgcttcatcttcaagaagaattatcattggggagcaaagatcactcattcctgatcatacatcacaaccaataaatgttatccaatttgtcacaaaatcctagttaaggaacccaacatcctctccctcttgactgtaagatttatatatctacttacataaaaagctagaaggaataaaaaacaagtaaagatattcctattagaggaaggataaaattaacgttttcagatatgtaacacaccttgacaatagccaacatctttgtcaatccaagcataaacagctagaatatcccagagctttgctagattctcttgcttctcataaaataccagggtcctatcagttcgaagcacatcgagacctaccataaatagcacttttcttgaaaatctcgctgcaaatttaagaagcaagaagaataaaaataaagccatcaacttcagtcataccgatttgatgtagtgtaagcttccactcgattatctccttatccaaaggagcttgatctctatgttcattattctcagcatttccatttgaagtggcttccataagcaccagtgggtcttgaataggctcaccatcttcagtgattattggagctgtaataatcttgccactaccaacatgagaatccctctgccgacactcttccttccatctagcatactgtactctgcatggaatatatagatgaatttctaaatttggaattttgtaggaattttatcacagtttctgagattcgacccagaaataaaaagaacaacaataacagaaatgatgatgatgatgatgatgatgatgatggcgacaacaagatgaagataatgatgataacacaaggtaaagttgttaagactgtttagagtgtacactgaggagcatgaatcaacagcaatatagcacaagatgcagatcagaacataccctaacatacttcccctaaaatgatggtaatcaaacaaataacttgtatgaaagggttactatataaactgatcttcttatcataccaccctcattcccttaagttcttgtagtttatgtaggatgtactaggaatcttggtcatagataggtctatctatgaaaattgtttggagatactagacagccacaacctaggtcagagattccacttgcaggaagggcttccaggaagctcattggatgggcatgaaaaaggaatttgagggcaaagaagacttggagaattatcatgagtagagattagaagatgccaagcattttgatgggcaggaccatgggttatgagtcaggacagagtttttcaccaaatcaggaaggccttcatgtaattccattcagttatgttcatttcagtgtctaagtatatccacacttccatttaacgattgactaacaaattttataactcaattgggtttgttcgatagttattttcaatcctttatatgcttaacaaaatatttttgctactttgttttgtcatattcattatttgccgagcaagtcttttctctagttagtagcttctaatgataaacaacaactaccccacaaataccgtgctgaacaatcaatagctgatagaggaaatcttagatgctttgattcaagagcctcaaattccaattgatgccttgttaaaatagtcaatatccacatcaaggtatatcatacaaaattccgcaataaggtagatagaaactatagcatagatgaagccctggggaccagggtgacgagtgcagtttcggtaatatggagaatggtggaactactccaagaagttccttagagcaataataaagaataaagagagatcaatgtgatactatggtgaacttcacatggtaaactcattgtagtcaagagatattttggtcacatgaagagatttatggaagcatacaatctcaaaggaagagctttaaaatattattcctattcaattgaataatcagcttacattaatgtgcaccactttttgagatattattgaaactaataacaaaaccaaagaaggaaaaagagtgtatttacaactttgcaatatttagctaaatataacaagcaggtgtgccttggaagtattactacctcctatgctgtctcagctgctctcgctcctcaaaagtgcttttaggatcaaaacagccaagcagaaactcccaaacctctccccttattgaaggatgaacaccctaatcaaacaaataattgaaatagaagaattaggtatccataatgttgaaggctctcggacaaacattcaagggacggagacaatcttgtcaaatttaaatatgttgatctgccaatgatgcttggtttatttccatagaaaggacttttaaatagaaaggcctcttcgcgtccatttatttccattgtgaatgcgatggatggagaaacttcctcacatgagataaaagaagaagctgcgtttgttgacttaccccacgctgtatccggctaaggactgaggcaatatccaagtgaccttctggactaaatgccgcctgccatcttcgtgcgctcagagtttttccagcctgcataaacagatgagagcaagacatcctcagctcctgtgctatgcctaatgggagaatacatgataagggggatccaagaccaaccaaacattttaaaaaaaaaaaagaaaagaaaaaagactgcccttcatgttaagatatacatttgattgaaaaaaaaaatctacatgcaagtcaattactcagacaactccacaatccatatgtgaagcacaagtagaaatgcctagatgtaattccgatcatcttcacctatcatccaagaaaaaaattagaaaaggaaaatggtgaatttataaaatctggatttttttttgggaattccaagaaaggcatgatcgacatgcatggttcttggaagatggaagcccttcacttatgaccaacaatacatatggagaaaagaaaacataaaatggtccaaatgctatctagcctcaccagtattagcatttaaattcacttctcctatgaatcctaatcatcagttcatgtaacacgagaaaacaataaaaattgttcaacatgcacgttccaatcgagaaagatagaagaaaaaaaattaatcaaaaaaaatatatatatttaaaggaagattgagcccgaccctgatcttgaacttgctctttggaatatcgctgcactccggacggacctcgtagaaagaatccgctggagcttcagtgttcctccacatccctcaccagaagaaaatcagaaacactatctcgaaaccgccaaaaaaaaaaatcctcgaatctccgcgaaaaacccaggagaaatctcgaccacgacgctcgagctggatcccacaatcaccgaatcaccccaaaagatccttcctttatcttctgctgggattgaagggatccagatcgggcgtcgggcggaagcgaaatcgatttgggggaaagttggaggaagggatggtgggggcgggagatggggagagggctagttttgtaaaaagctcgggttggaacggttcatggctccgcgtataaatgatttatttagatgttatgtctatttagttaaataattgccggtagagggaagagtcgccgacgaccaagacagacagggagacccgttccaacgccccctccgactcgcttggttgctccaacgaccctggttaggtaggttagtttagttcctttctttagcctctttggacggatttgggctgccaagtttcctatgtttcttctgcgatagttggggaacccaaatatggcggaataacttttgtcctgctctataattgaagggttctagaatttggtaagattctaaacacttatctcattatttctcttttttttaaaaactctactatttaagctttttcttaaacagccaaatttattatgacctaaatgttgcccaaatagagaagatttttttggatggtgtacgtgcaaggtggtgagcccttttttttttttttttctcactgaaccaaaggaggttttcctggactgaaattcgaagatgatataaagtatagacatctaccatcagtagtagactaagctggggtaggatctgatcgctcctatcaacgataatatctacttcaatggttttggaaactagccaattggtagccggattaccttctctgcgtatgtaagaagctttgaaggcccatgtagttgattcaatccagagctaaccataggtcaagcttggataacaataccaagagtaattctgatatagaaaaaatattttgtcccacctgattgggctacgtaaccatcattttctaatacatatttaatatctacaattttattttttatttaaaattttaaaagacgaaaatatcttttttcttcttcttaaaaaattacaacatctcgtaaccatattatgatattttacaatcaaattatgacttcctatacatcggatgccataaaaaaagaacgaacacttttgtcattttaaaattttataaattttcaatgatgaaaatatccttctttcattctgattatgaaagaaaaattatgatattctatgtgcaagaagtcataatttgataataggatattgtaatatgagcacaaaatgtcataactttttcagaaaaagagatatattttcgtcattaaaaattttaaatgaaaaaataaaattgcaagtattaaatgcgtgttggaaagcggtggctacatgctcaaatgtgattgaatggtatgctctatatcaattttattgcaccgcatacggtgcacaaagattttctcaaaacatcaaagtttaaacaaatcaaacacaaaatttgactaaaagaaaaatagttttggcccgaggcccggcccaggatcaactttaactgcaactggacaatatccttggagaggggaatagctacagttccgttactaaagaaaatattaatctaagagattacggtagaggaatcaccttccaaaactatcgattgaatatattcctttcaacaagaggcttaaaatgattgtaactatggaattagaaaagtatcatgggactttgccattgatcatacaaaaagttccatgtgccaaaatgatatggaaaatcttaatgtgattaatcttacatggattgcagctctaggcataaaagaccaaggcagctcaacatatttgaaggtctaaagataaatactaaaatataattttttaattaaaatttatataaattttttattaaaattttatttttctagctttttgagatacaaaatttttaattaaatttttataatcaaatttttataatatttttttttcaattgataatatagccaatctatttaatctttcttgagatattgttgatcttaagtaagattttattaattttaatttttaaaaaaaaatttctgtcgaagcaatatttattgaaattgttaacattattctaaaagcaatatatacatttgaaaaagagtcgaatagtcttatatgattgaatatgtccattggactgttatctttcacttgtataattttttaaaaatttttagcactgaaaataaatttaaactatcaatattagaatagttattatattttaagaaacattcaagattaagacaatattctttcaaactatcattgtctaatgacttcaattttttactactaaatagaaaattaaaaatatttttatatatcttaaattatttaaatctactttggagtgaaaaaaattgcttgatctactatatataagaaataatcaattctaaatgattcttcaagagattttattatttcattgtcaacatcctcatcaaattatttctttttacgaatgatacgcttatcatgaaatttagattctattttcatttcagatacaatttctttagaagaaattatagcggatgcaaatctatcttctctgtatttttcaaaaaaaaaaattaattattccatagcaatatcaatatgcatatcttttaattgtaaatttttgctaactgagttaacaacaaataatatatcataccaaatagtcatgcccaataaaacttaaaattttcaagctcatatgttactaagcaattagcttcacttttaggtttagaatcttcactaacttttgttaattttaataaagcatctttatttgtggagcttgaaattttattattttaacactttcaatacgactttttcaacatatttatgataatgatttaagagttagatcaaaaaaattatcttgtaaaatttttcatcatttagtagaaaaaaatagtgaatatatacgttgtaccactccaaaaaatgatatagctttagtacaagaactagccatatcataaagtactaaatttagactatgacaaccacatgatatataaatggatataggatttatatctaaaagtcttttttgcactctttactatttgcccttcatattagatctattatcatatccctgtcctcttaaactattaatatcaagtctaatatattttatttcatccataatggcatcaaaaagatcttttctggttatatcatctacttttaagaatttaaaaaaaatatttcataattttgattgaacttgatgaaatatctacacatcacagtataaaagatatttgctcctgatgacttacatttggagtgcaatcaagtagtattgaaaaatattttacttctataattttttaataattttatttttaatttcacttgctaacaaatttatcaattcattttgtacattatgtccaagataatgagtatgaattttattatctttaatacatcgaatatgttcttgcatcatcggatcgaattctgtaatcatttcaattagacttaaaaaaatttcattatttttttgatagatctttttatttttttcataaaaagtcaaattatttttaccaagaatttttactacagcaagaattcttaataatatttttttccaatattcttcatctctatttatttgttcttgaatacttttatcaattattttattttttaataatcttatttttaaattaatacatgaacttatattaataatatgctcataactcatgtcatgactcttaagcttagcgatataatttctccaatctctagtgccaacattagctagtttacttatattagaagcagaattaaataatttacaataaaaataaaataatttatctaaatcttttgaataaactagccatcttcttttatgcttctctcaatttgctaacttttgaacttagtatatagtagaaaaatatcttgaaaattcatctttagaaaaatctatatcatcaattctaattggatctttttctactaataaatctctcaaatttatattaatatttatccattaacttggatcataaatatttttaggaatgtaatcatttaaattaacagattagttctcttcaccatgactttgaggatcattttgaatctcttcattgacttcttcttattctaatattttattatcatctaactctaacagattattaacttgttcatttaaggaacattcatcaatannnnnnnnnnnnnnnnnnnntaagctttgaataaccagattcatatttttcgagttgacatatttaaattcttattataaattatcaaaaaaaatttaactattacaattatcttatattttttaaatagctaatacaagatcaacaatcaaaatttctaattcaatgaatcaaatattaaataaaataatgacaaaatataataatataatataaattttaaattaaataaaaaatatgtaaagattagaataatagtatccaattgttaaatgctgattgcaaatgagataaataataaactaatttatagtatccgattgttgaatgctgttgtacaagagtacaaactataaaatatatgagttagagttattatcaagaagaaaagtaaagagaataataaagaaaaattaagaaatagatactataaattaaaaaaattatttttttatagaaaaggagaattgtattaatttagagaaaaaataaataatcctgttgaacttacaaacacagaatgatccaaactataaaacatcaaacacttcccaatctcaaccagttttgagaatttacaaactttccgaaggagtataaaaagtagataaaaaatcaaaaattaaataaaattttatatttttatagagctatatatgctgtgtaaaatatgaatcattaacaatatttatgtcaaagtataaaaaaaagtaaaaaaacaatccatttttatagaagaaatgaccaaatgaccattggtgctagtccggtaattggtcaaaattaatgagaccaaatgaccgttggcgctagtctgataattggccaaaattaatgaagcaggctgcccaccgccgactcccttttttttcccacgttgccgtgcacagtaaccacgtctgccacatgttcctcggttctgaggaaacacaaaaaaaaagaggagcgacggacctttcgtcttccactcttccttgccaccaatgatcggatgatcgatcgtcagtgacttgtcagccactcagggcctccgatgagtggcgtcgttcattttctcgcaggtcgagccgaagaggaggacctgggggcaggggccttccagaaaaatgaaatcatccgccatcgcgttgctcgcggagaccttcggtctttagaagagtttgacacgcgacgtcggtgccgttcatcttctcgcaggccgagcggggggaggggggcctgggggcgggggcttttcgataaaaaaaagggatcatccaccatcgtgtcactcgcaaagaccttcgattccgtgacccatcttcctcaccactggtgaccagccgaccgcacgctcagccgttcttccttgtcgtggcgccgttcatcttctcgcaggttaagcgaggtgtcggagccacctggggactggaggtggctgagcgagggccttccagggtagagacctcttgccgttcgtcttctcgagggctgagcagggggcctgggggtggaaccatggagggagaccttatcggggtggaggctgggagggggaggtagctggggcctaaggcaagggcttcggtggccttgtccttcagccgcccttgtaaaagacttttcatgaaataagaaagaccaacccagaaaaatatttttatgaaataatatatattatgaatatataattaaaatgagggatcacaattacaatgattcatgctctatttcatatacattaagattgttacaagaaatcaacatctttttctcactgttaaaattaatatatatggtttcagatgagtcatcaatacgctttctcctatatgtattaaactgctctaaatgaggttattaatttgggagtaacttgagctttatgcaagccaaaaccatagtttctctgtcatgctttcaattgctctaataaaccacgtgaaaaaaaaaaatgctctaatagttattccattttaatgatgccatattggagttattcaattttgacaaagctacaggagctttcatataaaactgttataggtcttaatagtcgtgtctggctatgcatcaacaatacttaaagtataatttataaagtcttaatataattcgtaaatttcttcgtataacaagccaggcatatattttcaaaaattaatttgtagatcttggttcaaactcggacttccacctaacaaagtaccaaagaactagctcaataatgtacccacttgctttccgctcagaggtcaagggtaagaatattgaagtggtgttattcgttaagacttcaacctcagcttgcgcagaaatttttccagaatacaaaaattcctggtaccgtgagcgatggtcacaaactacccaataaaaaggatagtaataattacttccttgagtgtatttccatgtgaacaccgtggaatactgacgtgaacttaaaaatagtgtctgcaacccattggcccacactttttaaattaccaacttatcttggattgaacatatcaaaatagggatggcagctaggtagatattttcggatatccaacccatccctaatcctaataaaatttatttagcatatcttaacaggatttgagaatgatttggaactaaccgatattttttaaattatcaacttatcttggatttaatgtatcaaaatagagatggcagtcaagcggatattttcgaatatccaatccactctaaatcctaataggatttatttagtatatcctaagactttaactttagttatccaaaaatttttctagaattcaaaaattcttgatactgtgagtaatgatctcaaactactcaataagaaaaatagtaataattagagtaaattatcctcgtccctcttaagatttgaggtaattacataatcccatataacgttttgaaaatatacacataactcctaatcaaatataaaaatttaaaaattaaaaaataaaaatttataaaatattttaagacttaaataaattagatagagatgatattagtaaaaattatcaaataaattggtagtttatttaacagaaaaatattcatagcgaattatgtgccatatatatatatatatatatatatatatatatataattaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatattaaaaattaaataataaaatatatatttttaaaatattagatgaaaatttgtaattatcctaaattttcagggagttcactataatttatcttaataattacttctttgggtgtatttctatgtgaatatcagtggtacactgacgtacggaaggggtgattggctgtgaacgcagggctgctggacgctaccgaccctgccatgctactcaccacttatcgactgccacatgtccgtacttcaagtttccatgccatttcaggctttcggcagaattcttgcatacagcctctcccgccccgtcgatagagctcatattcttcgtcctcttgttcttttctctttccttgccgctgccgttcattaaaaaagaaagaaaagaaaaaaaagaaagggaaaaaaaaatgctctctgtacgaaggacaatgcttcttctcataaaaagggtttcttcttcttctagtgttcgggcccttgccgttgccgcgccttctccggccgatcccccgccccaccgcctcgacgacctccttcgatcccacctcgactccggcgacgtccccgccgctgtctccctcctccgccactccttctactcccccctcgcccctcctccggcttcctccgtcaacctcgtcttttcccatctctctaaatcccgccagttcgagtccgtcatctccctctaccactcgctccgcgagtccggtttctccgccgatttggtctccctcaacatcctcatccactgctattgtcagacacgccgactggacttcgccttcaaggtgttcgacgaaatccgcgaacgaagctacgcccctgatgttgtctccttcaacactctgatcaagggtttctgcaatgaaaaccgagtttccgacgcttttaaggttttacgcgagatgagggagaatgggccgagtccaaatgtctacacctattccatgttgatcggtctcgtgtcgcgaggttgctcaaattctgagctgggcttgggtttgattcgagaaatgttgcaacttggattggaaccgagcatggttaattgcaactgtgttctgacagcgttgtctaagcagtttaagatcaatgcagcaaaggctctctatgggaggatgagtaaatcaggaattgtgggagatgttgtctcttatacttgttttcttgatgtcctgtgtcgaaagaggatgataatggaagcaaaaatgcttttttctgagatgccagacaagggggtggcacccaatgtggtgacctacaatactatgattcatgggctctgtgctaatgggcaggggaacaatgcaatgggaatgttagaccagatggtgatacacggtctccggccaaatatagtcacctacacaacagttattgatgggctttgtagatatgggaagctagaagagacattaaatcttttggatgtgatgaggcagcaagggttagagcctgacaagcaaatgtatggcacgttgctcaatgggttgtgcaaaggaggcagagtggaaaatgcactgaagctatttcgtgaaattgaagctattggattcaatgatatcgcttcttacaatagtttgatcagcgggttttgcaaactggggaagatggaagaagccaacaagctttttgaggagatcatggagaaaggattcaaacctgatgtggttatgtataccacattgatggatggtttctgcaaggtgggtaaagttgaggctgcacaagggcttataggtgctatggaaaggcagggtcttaaacctgatttaatcacctattcgaccatggtagatggtttttgtgatattgagcaatttgatgccgcagaagagctattgtgtgatatggaaaggcatgggcttgaaccaaactcagttatctttaataagttggtatatggtttgtgcaaggcagggaattttggtagagctgagtattatctagaagagatgagccgtaaaggtcaacaagtcaatgccaagactcatcatattctttcaaatggtagggcaggaagattccaggatgctgagaaattggctccttcatgtggcagagattagatggaaactgatgctggcataaattagtgtatctgtgattatcactgcagaacagtttaacaaagctaaagaagatgggtgacagaaaaatgtttccaaaaccaatttataacttacaatgccagcattcagatcaaaggtaaagatgaggaagccataaccatgtttcatgaaatggttgtaaatggcattgcttcatttccacatgcagcttatcttttccagagcatttatgtgtgctggccagcttggaaagttcttccatatgctcccagtcacattggaaagcaggtaaagaatggaagttgatttgcatgctgtaacggacgaatctcatgcggaagctgactacttggaatgaaagaactggttgcagggcacttgctgtcaaactagtagagtgctcagactgtcagctattcatgtattcttatgatagtttgattctttgagcataaaatgcttcaaattctgcagtatgaaaaggccaatttatgacatgattctgttgaactaagaagtcatgatgttcctagaaaatcattcatatacaatttgtaatacttaatttcatgcaatatgttatattttcatggagcccagcggcttctgttctgttgtcaaaacaagcacatatattttttcaaatcataatatgcccttatggatggtgacttgagaattgtgattttgtgggcaaatggtggaaggcctccttgggaacttctccccatcaattgaccctgccagaaagggcggattatccgagcatactttccagaaggacaacaactagcagactcccctggtactcggagatggtcgatctctaggtaggaatttctataccctgtgcacaagtttggcgggactctcggggcccaggcctccaaaggtgcgtttggttatactctgtgattttttatttttaatttttaaaatatattttttattttttaatttttattattaaataaaaataaaaaataaaaatatgtttgataactacgttactataaagcaaaaagcaacatttggaaatgacagatgaagagttcggcgaacgaaaagtatttcagaagggagggagaaggaggtggagaggtgaaaagctcgacgaagaagaaggattcggactctttactttttaatttgatatttttgatataaaaaaataaaataaaaaataaattttgtaaaataaaaaatttttgttttgcatataaagtaattattttgattattttgattttgattttttattttttatgatgttatcaaatattatttttaattttatttttaaaattaaaaataaaaatatatttttttaatgtctaaccaaaggcaccctaaatttttaggttttcatgctctgaccattctttttatctatatcttgtcgcgtatcaaatatataatttcttgataggtttcgtgatggagcctgcaccgctatcataccatcctactgggtttaatttgctgaaattgctgttctttcaggggacactgctggaattggtttcataggttgctggtgccttgctttctgtcaggtagctgctctacttaatgacttgaggttgttgacactttagtgaattaggattggctaatcttatagagatgctcttcaggttgtcatgttggcattgcaatatttcgtgagaaaagcttgttctaaatttttagttttccttttttttttccctttaagactgggtcagctcagagatgccaagagtttgatagaattcatattgttttcataacaatttctctggctcttatggacaatttattattgctttctctgcatagccacataggtgcgactttcctaataatgaaaaaaaacaaaattgtattcaggcaagtctaagtttgctcttggctattggaaagtattttctttattgttggttgcaacattctatggtctgtgagaaatgatggtgttccagaacttatctcttatgtactaatggctgtcaagagacaactcaataacagaaaaaaggagagggccctatgatagagaagctacacagaatcacggtttacacaatccattcgtaattaatcctgctgaggatttttgggtgaatattttgaaacaaaaatatatctagaggcagctgtttaaacaacagttaacacgatgctggatcaacttttttgcatgcttcattctcttgaaagggtggtttagaagttctagaatgagcatgattgtaaaataaattgcaattaacaaattgcctgtttgttctgatcttcaggagattttatcaatgcaattaaatgtcgatttttgaactttagggtcttagctgcagtaaattgtgcaattatcaaacaaaaagaagaaaaagaaaattatgataccactggaatgtatgccattgcgatacaaattagtcccagccatctttggttgaggtctagtctcaatggctagagtgctttctatataatttttgctttgttgggtataaaatacctcccgaccgaagtttgtaaaagaccgatccttccaggacttttccggcttccgatcttgtgtggcgtctttctgaaccctctcgaccgtccgagctttcataataccgtccagacttctctgacaatgagcttctccacccatctaccgggctgttccaaaggctctctgggcctcactgtcagccgaccttctacagtgatcaactactctccgaatttcttccggacttcgtcaatatccgagcttctccgacaacgagattcctacagtaatcagactccatccaagtttctacggtggtcgaccgtcttcaggattccaatcgaactcctgcgagagccgaacttctactacgggcggtctactccgaactcctacagcggatggtctactccggatatcgactgtaagtaaatttcattcgagcctctacagtaaataaatttctttcgaacttctattacaggtagacttcagtcgagcttcttcgtagtcggatcccagacgagcttctacaatgggacaggatccaccggccagatcgctactccgagctcccacgacaaccgatcttcgatcgagcttctacaataagcggtctcttttcagccttctacaagaaccagactccatccgaactttcatagcggatagatatcggacgagcttctacgacggacgaactccggtagctggatttctacaatggtcgattgcctccggtgtttgtcgaaccttcccaacgccatccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccggcggcggccgcagtcatcttaactctagcaactccggcttcggcagaattctgcaccaacatgctttaattagtttgtttatccttctttttttagtagagagagtgagagagagagaggagggtttgattaggatttgattgagtagatattcactcggatcaatcatgtatcaacgtttcaagtcattggatataatctatcatatttaaaattatttagatatcaaaaactatataatttagatatatataacttatatatcaaatggtcaaaaatttgggttgtttaaatttagtaaaataatttgttttttgattatttattgcatagattatgatttttaaattataatttttttattatataaataatttaataataatagatcatattaaataatttgggttatcaatattagactgtcatcatttaatattgattcgattggatttgggtggagatcgatcaaataaatcttaagagaggaattttttttttttaggtagaaaacagaacagctgctattttcataaaggaactcaaacccatcgtccgaagctacaaaagcacaacaaaacatccacggagcgtggcatacattgtgattggcccactgcgtacataattacaaggataaacatcaaacatagacactgctcgatgcagtcctcaaggagggatttgttttattattattttttattaaatatttttaaaaatacgatcgttcaaaatttattttcgaatttacagttcatgcataatttcatgtgatttcatgatcacagaaccacttgacgtggcatagaaaatcaccgtttgagatggcaagttcaatgaacacaccagtccaagtggcatttttagaaatcaccaatccaattgatgagttcagagaaatggcccgttggatcgatgatttcaatcctcttctatttgtcatgtctgtattctagcctgaatcaatcttatgatttcaaaaaaagatgaaaatatttcaaaaggaaaaaaagctcgagtagacaaaagacaacaaaaatctcagggtaagtatgaataggatttatttctgaactctgagtttagtaaaaaatatcaagcaaatttttttcaacgaaaagatgtagggggaaggatagttaagttcttttagtaatttttgaattaaatttttatttgaaagaatggattggctttttatgatcatgttgaacaagccaacatatcctactctagttaaatatttttatagtaactttagctttgatagatcagcttgttttattttatcctttgtaaaagaaaagactatcgagtttgactgtgatatttttagtcaaattttaggtattccatcagatggtgatagatattttaatatcacttgttagagtcataatagattaggttactgtagttgtattagaactatttttgaggacgatagtttggggcaaacaaataaacctagtgcacatctattaccactgaaaaatagattaattcatcatatattaacatccaattttctgcctagaggaggtcatggagataatatatcacacatggatatttatctcctcacaagaattctttcgggtgataaagttaatctgctatatgtaatgataaactatatgattgaatgtcttgaaaaattcaaaacctgtttgccttatggagttgttctaactgctaactttgaggcctttgatatccctatcactaatgatgataaagttgttgaggtcagacccactgacatctacgataagtcatttataaagcgtatgggctatatttttactgatgatggttggaagcatacatctactggtgaagaagaaagtcatcatgccgacattgctcagcccagtcatcatatgcagtctgattagcaatcttatgatgtgcatgcattgtttgctcgatttgatgcactgaagactgatgtcagagagggatttgtatgtatggacaaggggtttgcacgatttaatcagttcatacagcatttttatcgtcaattttctgtacctccataggactttgcagtggatgattaagctcctacttgttatttcactatttgaggcctcacttgatgatgtatcatctattttatttattttttttgtaatgtaatcttgtttgttttctaatgaaattatgtattattaatcgatcaaccagtcttctcagtcgatcgaccatagaaagtcgagcggatctcttgctcaattgatctagccaatcgatcagggtgtctggttagtcgattgcactcagtcaacctgtatttttagtcggtcgaccatagaaagccgagtggatgcccatttgagccagtcggtcgaccacgtatctggtcggttaaccactgtcggtcaaccaatcttctcagtcaatcgatcgtagaaaatcgagcgattcgccttgtcgctctggccggtcgactacggtgtcggctggccgactgaggccgatcgatcaatcttctcagtcagttgatcgtagaaagttgagcggatcatggctgcccgattgatccaatcggtcgatcaggatgtcctgttggtcgatcaaggtttggctcgtttggtccgatcgattgatcgcaatagctctagctcatgctagagtggttgattgccagaaaaccctggttgaccgtctgaaaaccctggtcgaccagcacgactccaacccgattgactaccttgtttgattcgagatggaaaacatgggggaggcttagctacttatctaagctaaaacaaagaaagccatagaaacatgagttcggtttaggatgaggggggattgaggagattagggttcgatttaagactaacacataacctagaccgaataaatgataagcaacatgaaaaaatcaaaatcgcgcattatatctccatctgagcatcatacaaataacatatcctgatcatcatactctatttcaaaatcaataaataaataaatttatttatagaactagcaatccaaatgttagaaacatgtaatacaaaacaaatgaagtccaacatcatggaattgatcaactaaaaacttgaacatcagattggcacaatcaactccaaacaaagtcccatgtaggtataattaaatcaaaaatagaatcaagtcccacatggcagtcgtcgcttcctcctgggtggttgcttgcaacatgggataggttgggcttcacttggactcccatgctcctcgatgccatgctctatctgcgtgacagtgtcatctacaacttcctcacctataatgcccgcagtatgactcgaagctctctgatgggtaacgtcatctgcaacaactctaaaatgcgctactgtatcatcaccagattgaaatcgtgtcatgtcgtcgtgtatataagcctctgatgatatataagaattgaatgaaggaaactccagcacctaaaacttagagctgtattcgatcgggtagctcatctatgcatctcaggcggtactcctgacaatgatggataatgataaggtgaaggtgtggatgctgatgcactgtactccatggtgatatgctcgtgctcatcgatggcatgaaggaccgacagcatatatcctgtataattggcacagatgtagacatagaatctgggctacaaagatgatagatctgcaccggacttccactctaataaaaaaagatcaatcaaatatatgaatattaattaaaaaaatataaaaaaattattacttaccagataatcaaacatcgcatcaaaatgacaaatgaaatgataagtgatgtgatggtaccactccatgtaatcatcataataatgcatggcacgattcactactggtccattcacaacatggtcttgtcgatcctcccatattgcaaaaaagtgctgatgagtgatgctccagtcctgatcctagcgacccctaagatcgatatgatgcagtctagaatccatgtcacagttaggtggaacaacctgatggatcccaaactgccgcatcaccttatcgggattgtgccactctataatatgaaaatataaaagtggcacctaacatcgccatatatcctgtccaacgaagcaataatccaatagaattgcaagaactttcaaagtatatggttgccatataatcttattttttaaacattactaaatattagtattctaagccacttcgaagattatagcatacaaatcaattagatttttacctgctcagatcgaagttgatcaagatggtatctatacatccgcaggacatgagtgaaaacttccatcatcgaaaaagtatctctccacctacacaatcgagcgtcgataagttgcatttcaatcaacaaagcatcaataagcaaatagtcataatcaatattacttacgtacctcatgactagcgatccacgtggtaatgcgcctctatccaccaaatccttaataggatctacaggaggatgctttaatctatgaggatcaataaaagaaaacctatcccatgcccacatctaaagcaaaatcaaggatcccacaatctgatatacatctattctacttgctttacaaagctttctgtacaaccaagctagactggtactaccccagctatactgtcctgcagtctcaaaatcgataaaaagtagcaaaaactgttagatgtatgtcccagaagccaatctttgctgatatatacctttctctagagtatgttttgcacttgatgggcagtctttatatccaatcatgtcatttgtgtccatgatttatcttaaaaattaacaaagatgattttgtatattctcaagctgttaagaatttgagacatacattattagtggttaatttctaaatgctcccaattgaaggatcgtcacaaaggatagtgatcaatccattcaagatcgatgcatggatcacctccttttaggacagatgagtctcgagtctgtggtgtagagacagttgggtgagagtgcaggtgattgttagagaataacttatactgagcgtgatcaatacgtgaaaccacttggatgtctactcactcgtcagtaattttttcaatactgcagtggtgtgactggtcttttgacctgcggtgtgctggctattcgcagtgaggttacttagtttgactacacgttctcttggtctctaaccattcggatctttgctgtgtatgttggctattgtaggttcagatttattgtttagagtaggatgcatctagatagaatctatcgatcttgatagaaaagaagaagtcttatgcaattcgtaagactgagttcaaaaaatttctagttagagtaagtgtgaatactgaaaaaaattttcacaggattcacaaatgaacttgagtcgagccaatctagcatatgactgatgatagagtttgatgagttctctatgacctctgtcaagtcaaaactcacaatagagagattgtatcatacgataactgtatctagagatttatcttttctattctactggattgccactacatactgctaggcatcactagtagatcgtgagaactcactaagatattttcagatcaacaattcttattgaggtgggttgaaatcatttcagtccatcaaaaaaggtttcgatgatactgtgatggagatcacggtatatctcactaccaaacagaatagaatctaagaagtcacatacaaaaaagagcataatctgaccaatggcttggatcatattcgaattatcaatcgaattgatagtttgaatttttagaaattgctaatttgtaatcgttacaattttgacaactgctaattattagcacaagaatttaattataaatattataattttttgagattgattaaattataaattaaattataattaattttaattaaattaaattatatttaatttaatttaatattaattagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatagcctttcgaattcgactcgattcaaactcgatttgaacccgattaagacccaacttgaactaatagaactatgactcagagagtctaggttctctgagactctctctccaaaatttatgctaagaaggagagggcatgcattgaaacgtgcttcttatttctacttgtgcgctattgacgccccaccttatctgggtttctttttctttcaattttttttctatttgaatatgattcaaaataggataaaatttatctgattagggcatgtaagaaattatttttatgtgacaaaaatttgaagaaaagtggacatgcgctaattgtgagaagagatttctttcttgcaacacaacattatctccccacccttccaatctttgatttgggtttcaatgccttagattaaatgagataagatctcttgggtgttaaggagagggtgtgcatgggatatgaagtggtggtgcgacaaagaaaaaaatgggcgtgaggtttcttgcattaaaaagaataggcgacttcttttggacataagaatatttcaacgcccaacttcctcctccattcttcctcacatctccacactcagatctgatagagatcagatctaagagagaaaaagagagagaagaagagaagaagggttcttcttctcttcatggtgatctgattcaaatttcgtcagatctgtgcgaaagaattcgcgcagtgatctccttcttcgagatctagaagaagagatcgagatctgcaaggagctatcacaccagtgatctcgatgctccaatcagatatctctgtgtggataccagcagaagtcggacgtatgtgtggttacgatcaaaattcaagacattcgcaggatccaaaatatgaagatctgatctctgatttatttttctaacaattatttttttttagatttcagattatgattacatattcgtttcaagatctttgttatgattttcagatcaaatttgatacatgattaaattaaaaatattttaatttatttactttcactgcttaatgtctagaaaatttttttaaactatacgtatgaaaccgtaacagttttctaacagtgatttcagagcataggttctgatacaaatatgaaaacccctcagatttgaaatctgatttgtagaaatcagatttgaaggttaatttgatgatctactcattctaaaataagattatcctgatataactctgttatgctgaacggttgtcttagaattttctacatgatgtaatatgattacatgattattttgaatatgaaattatttcagatctaaaataaatcatgaattattcagatctaaaattaattttagatctgaatatattaattagagtttaatttagatctagtatgattactaaaatttttcttacgtgcatagatttaaagttattgttcatatgtttaacatatgaaagataattagatctgatttttaattgattacatatgtgatatattagattaaattcttagtagcttagtaatcaaattgggataatcaccatagttgtccggtcataagatgatgaagggattaaaattcttctcttttttattcgatgggttctctcttatgacgtgtaggggtgccgactgtgatattttttatgaagatgaacgacgaatgaaaaattatatgtgatgcattttttagatttaaatcagattatgtatgtatttttaagtattttagatcgataaatattatatgtgatatattgtttggacacatgatctaaaatttaatttctaaaaaaatctagatccaaaatcttaggttctgtttgtatgaaaatataaaactgtgactggtatgcctgtggagtcgactcgattttcaattggatcaactcgagtgcttagtgagttgactcatttttgttagagtcgactcatgaccctgataggttggctcatttgctaatgagcggactcaattatacagattaggtctacagatttttatttatctcattatgtactgactcactgtgataagtcgattcatgtaccagagtgagtcgattcgattctacaaatagtgatattatatgagatacaataaaataatttagattagaaattatttcgagatctaaactcaaatccacatacataatacacttaattgagaattaagatttgaaattataagatctaaaattatgaatttaagatctaaattttaatgcataaaatatgggcttcgggtatgggttgaacaaattaggtttagagactaaactataaccaagatcattgattagatcagattagaatcctttctaattttgagcagctgattaaacctaattaagagttgattaggattagatcaaaggggctcaaaaattaaatttagttgtagttgatcaaattgattcatatttgatgtgaattgatcaagtcaagatcaaatttagctcagtgattcgagctcggatctataggttaacctaattgattctaatcaacaaatttgatgtctaaagtaagtattagatggtggttctttaattggtttcattgactgacctgaccaattcgttggtatctaagcaatggggggacctccactcatctttatttacctgatcattttgagagattatattttgtattaggttacttattgactcgagttcacctatgccaactaggttgatcagacatgaaatatgctgatccaaatcagattagtcgttacatcagatgtatatgactaattagaagaaatctgaatctaaatcttctcactaaatattaagtctactgatcttccaccattgtagagatgcgggtgccttttttgacgttgatcgttctcgactggttatactagttcgattgcatcaaaaagacacaaccattctatagacattagataccctgaggtaaagatggggttagacccaataactattaaatgaggaacctaaagatggctttgtactcgctggtgaacggtggatcggacttaactaagaaatgtatcaataactattaggtgaggctacaggacttatagatcaagtcactgcaacatgcttggagaagtatctggataaagagctgtctatgcattggtatacatattaccaataactgttagatgaggtgtcatacattgatgggactgcagcacccactagaaccacttatcgtgttagaatttttgtttctccatccgaggagtgtaagagactcaaaaaattagtgaaagccttttgtttgtttttaaattttttagaataaactattacaaatataatcatctaattaaatctttactctctataatcacgtcttcagctttcaaccctttagctcaaatcctagatatcaaccacttaaccaaaatcaatgacatattctagctcaaaaatctaaaaatagttcttaacttttaaaaattaagtcatgattcttgaccaggttaacctaatatcatcagcttgtctaatctatagtcaacaagctatacttgacaaatagttggacattgacaattaggttaggtgctataaattgaatttcatagttgatgaaatccaatatatgcataaggatatgtagactgccaataatatgctgatttatcagcaatagttgtgagatgatcagagtcacacagtacataagatacgtgatgggcagttcgtccatgatcgatgatcaaagacattgaagagcttgaaaagctcgacatgactatgcataagaaattactaatagatttgatcctacaatctctgattcatatgaatagtttatgaaactattatatgaataaatatttagcaccttaattaaattgatcgatatgctggtaactaaaggatcttgaaaagtttagaggtacatacctggagaatctaaaaaaatattgacatgcctttgtaagatatgtcgaatcgctcaaatttgatcttataattttttttttcattagactctagtgcatattacgcactttaatatagggcctaaggaaggaagaggactgagagaaggtgaaatgactcttttgagtcagcaatggtgtaaaagttgcactagaccgtgggtacctaatctcgatgattatcgtttagatttaattctttatcatttgtatggtgatgtatttgtaaaaattatttgagcaaatagtgaatgccattggatctgagagatccagaaccaaataatctgaagtatattgatggctcttttagctaggtcatatatgaaaagaaatgatttgccgactagagaaaatggacttttgggctcattgattgttaagttatatctaatctgtgaatcatctctttgaggattaatgatcaagctatcctttgttgatcaaagggataagattattgagatttttatcctagtacacatacgatgtatatggcccatttgatgagtcagactaggaggttatcactgcttcattacctttactgaggagcagtgatggtatcggtatgtatgtgagatatnnnnnnnnnnnnnnnnnnnntcctaaaggtacttcgattatatcgaggatgtaataccaaatagaaaatttatcggttatctaaagagaatggcataatttcatgatagaattcttcttgtacacctcagcttaatggggtatctgtgggaagtaatagtgctgtataagatatagtccgatccatcatgaacatcactagttcaattattatttttttaaaaataaaatttaatttttaaaatttaaattagattttttttaaagttggtttgaccacaccatatgagatatgatatggtggataagttagaagataggtctatgagactcgtttatgaggcatcccaaaagggtttgggatgctactttctcttctcgatggttcataatgtgattgtgagcaatcatactattttcttgaaaactatgggaggatgaactcaaagaaaaaaatctaaagaataacgaggtgcaggacctgtacaacctatttaagatgagccagtatatgtaataaatcttccacctcgtagatctagtaggatctttcatcttttagaaaggtacttgatattcttacaaagaattcagagaaagtatttctcaagagagattgaaaacatagggatgatcccaaaacctacagcaacatgatatgaggaatcatataggtcagtggaagggtctcatactgacatcgattatgatgtggttatatatagaattttcttttcaaagatctagatcaaacattctgaaaataaatggtctatagagatagatcctaaaaggatgtttggttttcacagacaagtacataaaagaggtattgaaagagttcagcattaaaacctccaaaagagatccattatcttcttggatataggtatatgccatgctatgtacttgacttgatatattttgctgtgaaagttacgagcagatattagttaaatccaagctgggaataatggattactgtaaaaatatctttaagtacttgagaagcactaaaagattattcttcatttttgaagaaaggttagagctaagagtagaaggatacactgatgttgatggtagaatatctacatcagcatgtattcttgagttatattggtttggtatgttggaagggttctagacaatcaatcaatagaagctgaatatgctatagatgtgcaggatacgttctagttcttatgatagttgcggaacttgatgtcataccattagatgctatgatattgtactgtaaagataatggtccatagtccttgctaaggagtcaaggtctcaccagaagtccatgcacatagaatagggatatacgcgattatctcaaatagaaatacatagaggtacagaattaaactccacatagaatgtggtgggcacgagtcacttagtcaactaaatatcgaagcctattttcagaagatggagctcaggtatatagcaaattggctttagtgcaagtggaggtttgttagatgtgtatcctaaaagtcaatcttagctgacacatacctttctttaggacatattttgtacttgatgggcagtctttataaccaatcatatcatttgtatccatgatttgtcctataaattaataaagatgattttgtatatttttaaggtgttgagaatttgagacatacatcattagtggttaatttttaaatactcccgaacgaaggatcatcataaaggacaatgatcaatccattcaagatcgatgcacggatcatctttctttagggcagatgagtctccagtctgcagtatagagacactggagtgagagtgcaggtggttgttagagaacaacttgcactgagtgtgactaacatgagaaatcacttgtatgtctacttactcatccataatttttttgatgctgtagtggtgtgactggtcctttgacctgtggtgtgttggctattcgcggtgaggttatttagtttaactgtacgttctcttgatccctagccattcgggttcttactgtgtatgttggttattgtaggttcaggttcactgtttggagtaggatgtacctaaatgaaatccatcaatcttggtagaaacgaagtcctatgcgatttgtaagactgagttcaagaaatctctgatcagagtaagtgtgaatactgaaaaagagttttcacaggatttacaaatgaactcaagtcgagtcaatctagcatatgactgacgatggaatttgacgagttcttcatgatctctatcaagttgggactcacgatagagggattacatcacacgataactgcatctaggaatttatcttttctgttctactggattgccactacatactactagacatcattggtggatcgtgaaaactcactaagatcattttcggatcaacgatctttattgaggtgagttggaatcatttcagcccatcgaaaaaaatttcgatgatactgtgatggagaacgatatgcctcactaccagatagaatagaacctgaggggtcacatacaaaaaagagcatgacctgatcaatggcttagatcatattcaaattatcaatcagattgatagtttgaattttagaaactgctaatttataatcattacagttttgacaactgctaattgttagcacatggacttaattataaatattataattttttatagttgattaaattataaattaagtcttaattaatttaaatcagatttaatttaattagacttaatttaatttaatgctaattaggatcaattattcgaatcaaatttgaatttcaaacttgattggatcaggtttgacagtttttcaaatttgattctattcgaactcgatttgaatccgattaagatacaacttgaaccagtagaaccataactcagagagtctagattttttgagactctttctccagaattcatgctaagaaggggagggcgcatgttgaaacgtgcattttatttcttcttgaacgtgtgaaggagagggggcgccaattattggcaccccaccttatctgggtttcttttccttctaattttttttatttgaatataatttaaaatagaataaaatttatctaattgggatatgtaagcaattatttttgtgtgataaaaatttgagaaaaagtggatgtgcgctaattgtgagaagagatttctttcttgcaacacaatattatctccacacccttccaatctttgatttgaatttcaacgccttagattaaatgagatgagatctcttgggcattaaggagagggtgtgcgtgggatatgaagtggtggtgcgataaagaaaaaaatgggcataaggtttcttgcgttccaaagaataggcgacttcttttggacataagaatatttcaatgcccaacttcctcatcctccattcttcctcacatctccatgcccagatctgatagagatcagatttaagagagaaaaagagagagaaaaagagaagaggaaggattcttcttctcttcatggtgatctggttcagatcctgtcggatctgtgtgaaataattcgcgcagcgatctttttcttcgagatctagaagaagagatctagatccaagactgaagaatgagatctgtaaggtgctagcacatcgatgatcttgatgctctgatcagatgtctctgtatggataccaataaaagtcggacacgtgtgagcctacgatcataattcgagacatctgtaggatctaaggtatgtagatctgatcttcaatttatttttctaattattattatttttagatttcaaatcatggttgcatgttcatgtcaagacccttgctacgattttcagattagatttggtacatgattaaattaaaaatattttaatttatttactttcgttgtttaatgtctagaaaaattttttaaactacacatacgaaactataataattttctaacaaaaacatgatatgaattgggttattagatttatctgcaaacagacaccctccgaacatctacaagatgtatgccttagcataacactgtatagctatatcatctgcattaggaggtagcctgacgaactgctcagctaaccatactgtgctcaattgggaacccttaagtttatcaagggatggaacaacacctaaaaggtcaacacatatctgtcaccaattatggcatgtactacctataattggaagaccgtcgattggtaagctcaattggatgccgacgtcctctaaggtgatagtacactcatcatgcgacagatgaaacgcatgtgtctccggacgccaccgctctaagaatgcagtgactaagtgctagtctaatgatataaaaccaatgcggaagatatcgtaaaagctgatctgctgtaaatatggcactatacataaatctaacggggtcaacctagacctaacaagatccctacatcgacatcataaaaaattagaatcctacaacaccagataaaaatggtttatcaattttaaatgcactttaataattttgttcacatgatgttgaaattataaatatatggtataataactcacgtctatatatatctaaccatcctagatggctgatgaccgatgagtagcctatatatagagtacagattgatctaatagatctggctccataaatacgatatgctgctgtcgttaacaataacaaaaaggagtttagtgtcaatgtataaatgtttcaacaaataagtataacaataacagaagttgagcaaatataaaaaataatatttcataattaaagattatatacaacataaggattcgtatccaatgatacaaaagtgctttattgcatcttatgttcatgctcatgttcatgaaagcttacgaacaacataaggattaacaaaaaagcacatgtaatacaaagtttcactcatttcaaactcatgttcatgctctatttgttggacatgaacaactgtcatatccttcttggccacaaatctgacacctagatctattgtcgatttctgtccaatccatttcattcctaagccatgaggatcgtggtctttccttctactgtaatcattggcactatagtactatcagcatatcatttattggctgcgaccaataatcagcatgcgggattggatgaaattaatgagcataattatgatggcattcatccagattgtaacaaccatcaatgtatcatcagaaatcaatcgatacatgagcataagcagccatcaagtgggagcatggcaaataatagcactgccatttctagcatatatacgtacgcttcgacaaccttacaatctacacattttaattacaatcttaaaaaatatatatgcatttattaaaaaaatcctctaataatacaatgaaggtcttgcattaggttttcacccgagtattattgcctttgttcgtataaggttcacgaaatgccatttgtacttgaaacatcccacttgctctatcgaatcttgttacattatgggatgtagctttagattggttggcaatcaatcgagttgtagcagaaggagtaaatatttcccctttgtataatgcattctctgcttgggcacgtctcccatcaaaatatgatacaagctggaagaatgtgagctatgccaatgaagttactgacagaaaatgagtattttttagcactccattaaaatattcagataaatttgtagtcatcatgccgaatcttcggccaccatcatgtgcaaaacaccatttgtctaccagaatttcagacaaccattaaaaggctttcaagtccatttttttaattttcttcatatatttgttgaactttctcttagtcttgtatccctgaatctagtgttgaaattgttagctacatggcatagatagtatacatgatgtgcataggatggttgccaccaaagatattcattttgtacagcaactaatatacctgcatgctagtctaaaatcaaacagatatcccaacgtgatctaataagagatctcaaacaagctaagaatcagctccatgtatttgtcaattcttcatctactattgcaaatgaaagtaaaaaaaatctgattatttccatcgacagcagttgcgatcatcaatttctctctatacttttcatataaaaatattacatcaatactgattactggtcttcagtgcttgaagccttcaatcaatggtgcaaacacccaaaaaatatgatcaaatatagcaaatgatgaatgaccggtaggtgtgctaatgaactttatccaagatccaagattatattctgctacagtatgcagccactttggcaataagtcatatgacttatcccaatcttcatataccaaggccattgctttctacttcacctcccatagctttctatgactgatcgtgtaattgaatctattctttatgactgcactaatatcggcaataaaaattatgagcatttcttttataagatcccatatttcattgatgatgaaatttgaactaagtccagaatgatcttgcgaaagcacgatcgaaatatatatatgcagaccaacatatcttgtgatttcaaaataatcagcccatttaatggctcggagcttccaattacatctcatctcagtattcttacatttaataactcaaagattcgactttgactcaacaactttgaatttatggtgtatgtctattgaatattatcttactgtagtttgtagatctatcttatcaacaaaacagagctctttacagaactcattacctttttttcagatactataaggtgcatacaatctagaagacattggtatattggtagtcatccaatcaatgcttctaaatgtgactgaaggagcttcaaacactgaataatttgggtgctccacaatatgtgggaattatacatcataggatgtacccacttgttgagcatcatcatccataccttctttattatatacatcatctttctcaaaaagctaattatcaatatggatggcatcatcggccatggtgtacagtgaggcttgtctgataataggatctggcacatcagtatgcattaccaaatgaacaggatcctccatatctcttgcatcattattcagcagaacatgggccatacagagactagaagctccaacctgatcgctcgtttgtgctgtcaatctaatattccgatcagctacttcatcgtactcttgattaggaatatttctgatgtcctcaatgggttgcacatcaatgtacaactctgcactagataaataagaatgtgagcttacgattgaaaaatgtaatctctatatcttcatcatcagtaattggagcaagttcatatttaaaaattatcagctacataatagtgggatatctatatgttaccattattctatttgtgcttctatttatataaaaaaatttacataatttatcctctaactctccgaatttcattccatatttcaatctaatagccttttgtagttgctcagtatactctattccatacgatcctttaaccatgaaaccattgatataacataagaccatcactatttttactatttctattatctatagaataaattaatccgattaacatagcacaaattattcaaattgatcaaatacatggcacaaattaatttaacctagcactaaattaacacaacttaatctaattcatatgagttaattcaaagtaaaccaattaatataatctaatttacttcaaattaattcaagttcaactcgaatttaattcaaattattttaattaacaaaaaatataataaataaaaataaaaattaatctgatatggcacaaaaattaatctatttatttagttttaaatctaattaacataactaatccagcttaattcaaattaatcaaacaaattcacaccaatcaaaataatacaacaattacatagtagaaattaattaataaaaattaattaatcaaattcattgtagaaattaatctaacatagcaaaaattctaatcaaattaaactaattaatctaatttaatttaaattaataaaattagattattaaattaatataacataatcactgcacaaattaatcgtgactaacacaaattaatcaaatttatgatacaaattattaaaataaatgaaattaatctcattaatctattttatttctaattaaattattttaactgaccatagataatacattttatttttgattatttgaatttattttaaataatcaaattaatgaaatcaacctaactaatgtaattaaaataaaataagcacgtcacaaattagtcataataatataaaaataattaaatttaagtatatatttaaaaaaaaaatttaaaattatcaaatcaaaaaaaattatcgtggtctgttgagaaaatgtggaacaccaggagcacatgggaaaaccagaggtcgagtgccgatgatccaacaatcaaaagagaaaatcaaaaaaaaaaggtgggatccgatgatgtcgacacagacggcgacaaggctggggtatcgggctgggaacaggataggtggagggaccgattttgaaatagggccggaggatagggagatcggggggattggtaaagaccgcctgaaatcatcgagtgaaggagcgattactgatcaaaatcatctaatgacatggcaattttgacgtctgaccatgtggcatctctttttctacgtgggaaacatgcacgatatgaaattgtcttttcagatgataattttgtgtgtgagtggtattttcaaaaataaatttaaaataaaaatatttttgaaaaaaaaaacgaggtgactgttttaaaggccaacagtacttcaatctcccctgtgtaggtgtcttttcatgtgtcgcgtaccgcatttttcggatgtgtgattgacgtgtccagcattagcttttttttaataaagacaaaaagagcattgggtggtgcaagcatttttcatttagatgcgggacatgaaagataaaaagcttgtgctcgcacagattttttacgaagtgcgaatcagatggtagattctccccaagaatttctctgcttcaggcaatggtgcgttgtatctagttgcaattggataacacgtcagagcacattatctcactggatcgtatttcaccatctaatgctaaagtgtcatcaaatggatttggctttgttggccagtggggatgttagaaatggactccgcatatagaatcaaggatccatccaagagggggaaaaaggaaaagaaaagaaaagaaaagtatagtctagaatctaagatatttagatacaaaatgaattccaaaattcaaataaacggattgtaacaaggtctggtccattaacctggcacaggaagagtcagatggatcgggtctaccagtttgaggctttgcgctatagagtatagatctgtatctttttctttctttctttttttttttttatttgagaaaagaggaacaaccgggccacctacttcattaagactatgaatgaaaagcaaaggagtatgaatctgcaacgttgagttggggctacgccaataccatgctagatttgatatggttttgactcatgactatgggacggcccagtggatctagtgttatatggctataattgatggccttagtactttagtggttttcagagtgtggcccatcttatgccaactttagcgtcaacaccaatcctgattcaagtctctctacaggataggacaattcctgtaatgatgtctgacttgaagaatgccatgaggcaatggttggtgaactttggcacaaaattctttgatgcttgcacgatagaaaatcgtatggagtgggcattcttttttgccatgtctaaaagccatattaggatgggactcttcttactaacaaaatctactcatttcataaacttaaaaaaaaaaaatacagaacaaaaattagtgctatacttgtgaaaagttgaggcggtctacttgcctgcatcctctcttctttctcgtgaagcttctgtccaactattcgtgagaatttcctcctccgtctgtctgtggggtttttgatcttaatggaaataacaggttttgaggattgcaatagttttgcattcctttttaaatataaaatttgaaattatgtgttacagaatttgaggctaatatacacttgatgatttgctcatatatactttaagggatcgttcttttgtagataaataccatgagaaagttggttaatttttttatagaccaacttacccatattctcatattttttagatgggtaagttactttaccgtagacaacatttacctataaaatgagagagttttatccatctaaggagtggcaaaattatttttctatcaaccagtaaagtagacatttaatactgtacctcaaatgcctatcctcattttcaatatctccatcattcaatgcttaataacttagttaaatctaaaaaatataaggaacatcatagaaaatatgaataaattttaccaccttatccaggaaagtagtaatataaaagaacatggataacaaatttcgaagctactttcctatgtataaaagaacataagtaaattattttcctatctaaatattacctgagaaatatttatgcagaaaagtatggattctcaggcaaatcttatacctactaagcttctttgatatatatagcaatattcctatcacatcttcaagtaaattgatgcatagtttccagaacataatattcatcagtatacaatatatggttaggcgatatacatatcacatattagtcatctcatatcccaatatatatctctaaaaaattgatatataatttttagaatatcatgcttattagtatacatacatggtcagataatacatactcgttagctttcttgatgcatattgtatattttttaatacatacttaataatattttagtatacactttcaaataaattgatatataatttttaaaacatcataccgactagtatatagtatatagttaagtaatacatacttgtctgcttcttgatacataatgtaaattcttttgatacatatttgcaacgatctaacatatacctctaaacaaaacgatatatagtttctagaaaataaaatttatcgatacatttttcacaatcaaataatatatatttagtaaattagttatttaacaacctaatatataccttaggggagagctagaaagcttcaaggatgaacagaaagaagcttgataaacaaagatggacggccgcaactctttatgcatgtatcacaattttgttttcttcatttttttttttttctataagctacgagatagacatattttgttaataagaggagatatgactcttgagttttcacattaagatgtatattataggagacatgacaaaaagaaagcccgctcatgatgattttctctagcatgtgcattagaggatttttgtccatgaactttgccatttctctgcaccaacatggaatgagaatgttggtgcagtttatggaagctcgtgtgatctacgatatatgatcaaatcatcgcacatcgcaccagtgtatctgcacgacggaataaggggcagcactggcattccatgaatggcatgcacaacgagaaagttcatacagaagtgatagaggttaatttttggtatctttttcttgctatcgccttaatagtctaccagcttggtccccaatgcgaatattgggcatcaacgtcagctcttgactttctttcaacttttttttttttaaagtcgcatatgatacacgatcataaagaaaataaaaatataaaaaaaatgtttgagatatttatgctaaaatctattcagttattaaattttagaataaattaaaaattaaaattttcataataatattaatattgttatgttaataaaatatttatattataatataatactatatcatattaataatattataacattagctcgatagcaatacaataaatactagatatttattttagtatttttatagtaatattgttataatacaaccatattattagtaattatcatagaatacaatattatataaactattataatataatacaatgtaactataatattgcaatattttattatggcattaaaataattatgatatttttgctagtagtactatatatatattttgctgattgtcataatataaaattaatttcaaaggtaccatctaaaaatgcgcataaagaattaggcatgttttgagatgcacatagaactggaatagcctgacctagaaaaacggacatatgacggttggatcgagcaagcttattctaaatctatgatcattttatcactaaaaaaaatctttgctcattttataaagaatgtttggttagcataagactggatggtaggccgactgagagagtgacagggatagagtgcctaaaaaattttattaattgaaagaaaacagattagagaaggacaagagacacaaaaaaataatagcctcctccagccaaagaattgacataaaaagacacttttcgctctaatctttcttaaaaacaattgctcagcgctagatttcttgcctgtctatctcacgcgccgaacacgcattcgttaagctgtttatttaatcaaaatgtatttaatgggatgtttggcatgttagagtgctgctggtgagtagaaatccaatcactttaattaacttcattggcgcttctagtggatcatcaaatcagcaatcttatctgtgagaaaggtagtaggaagactcttatcccacttagaatagaagccggcaaaaaacaatatcctctgtattgtgatagtaagccttttgtagtggcatattgtcctgaatccatcttgaaagtggacgactatcgctcatttgggacacataccatatatggcaccaagcacgatcatttgaatcgtttgaagtccaacgatgagtggcagcccgttgtcgttgagatggacatggcgactatccacagcggtgtagcactccacgatgcgaaaagtgtgttgtaaaagattcaaactcaaattatatatatatataagttattatatatttatctttcaaaatgtataagtttcactatagaaaatagagagcaactagctttctggtgtggtcattggataaacgaactactactaaaagagcagtttccaatagtcttcacgataaacaacaagcctcatgcgaccatggcagaagtttttcactctcatggaaatatcacaggggcagtatcgcccataagggaagggaagagattagaaaactcattgagttgctccgggataaaacacacacaaatggagatgatagcattgaatggaaaaggaacagcactaaaaaattcacaacaaaaatttgctataaattcttcagccttgaggggtttagattgcaaatcagcaaatccttttcaaaaatatcagtgctggagaaagttaaattgcttcactggttagcgatcaacaagaagctcctcacaaagggtaatctttagaaacaaaagtggaaagccctgcagaattacagcatctgtggcagtcaggaggaaacctcaagaacatatcttcgtttcgtgtccctctcttagcaaatttggagcctcattgcagccaaaaagagagtcttaaatcctaacttccctagataactgctggactataaagagcagagaaaagcctaaaatcagtgcatgattctttaatcgcaataattatctggagtatatggaaggggagaaacaaaactctttcaattccaagtgaatgctccatactagtgcttaaggaggctttatttttatttgaaagttggactttaaagacaaacaagccacagttcttcacgatactaaaagaaatacagaatattgtatgtaaaacactaagagctctgagtgcaagcagaagggagaaaaatacatatctcacaaccataggaaaagaaagaagagacgagtcgaagccaacacctgtaatgtaatttgagcagacaccttcttctaaatattgcatgagcaacataaattctttttgcatgcaattcctaagttgacatctgtatcttgttgggaccacatcctcaagtagcccacaatacaaacgccataaatctacctcttatcttgcaaaaaattactccatggcctatgcctcgcattgttattagaagaaatatatagttatctttcaaaaattctattgcatgtgcacattaaattatcctttttttttaatacaaatatttctctcattagatttttggtcaacaatattaataaataaatattttaagtataaattagttgattaccttttggcatcaatattcttataaaaatttatatatataaaagcataacccttctcaatacaaacttaatgttaaatttcttagaaatattaatgtaaaagagtaaattttaatgggagagcttttaaaaaaaaggttgcaaggacctattatatgtgcggaagttgagaaaatagcaaactatctatttgcaggatgttctttcacttagtctggctcagctttcaaaagcattacatctccctccgatccttgattccattgaagatctttagtctacctagagaaacatcatgttaagaaagataaataggccagcaaaaaattgtttattagctactatcaactggtgtttatggttagagaggaacaatataatttttaaaagagaagcaacatcttccatttctatcagccatcgtgctatttttctgctccaaatctagacgtaaccaacattaaaaagagtcaaaccacaatcctaatgatgctggaaggtcttataagattcagagcctctcaccgactattagaaatttgaaaaaaagaaaaataacttactggaggctacaacctcattttgtttttttgatctttacggcacgcacattccttgcttgaaaactttgatgtgactatgttctcaacattatttttttggtcctttcgaatgtgaacccccttgcttttgtatctatgcaacatcagtgactacatggctacacccaccttttggtccaatggttttgctaaacactgatgagccctcattgtccatattgagaccaaaaacaagtccatttgtaaatactaaatctattttataataaaatgccgggtggttattctcccttttcatcaaaaaaaataatacaaaagagtaacaatatgcacttaaaataattatttattaatgttgccagccaaaaagctagcaagagaggattcatacaaaaaaaaaaaaagacatgtagaaagatatatatgtaaataattaattttagagggtaaatatgtaataaattatttttgcaagggtatgtatacatgaaaaatctaaaataataactataagacaaagtctaagcctggcccaccgccagctgccccctctttttagtccacccgtttctgtttaggagctaaatttctatatgcccacctatttattcctctatatatccatccttcccatcgaagctctaacccaactctagtcatggggaatatgaaggtttatgcggtcgcgtttctcataagattcatatatgcggtcatgcagattctcacgaaggctgccttcgatggaggcatgagcacattcatttatgtgttctataggcagctgattggcaccctctttgtagcacctattgctttggtgcttgaaaggtaacgattgctccaatctcttggattcgatgctccattattttcctgacatcgttgacatcttctgttatttaggaacatggctccgcccctgtcatttaaggtctgcttcaagattttcttgcttgctttggtggggtaagttgctttgaatcaaattttatgtttaagtaaaaaaaaaaaaaattcttttggattccaatatatccataattgtaccaatattttttcagcaaatataaatataaatatgaatattaaatagatatcaaaattggtatctatattcattctaaatagacatgggtatgaattggatatcaagtatatttatatttattttaaataaataaagatataactcaaatattactcagatatgaattagatttttaagtaaaatataataatgaaaataaatataaacggcctaatcataaacaatggaaatgaaattcaccaccaaggttgcacacaatgaacaataattaggcaatggtttaagaggtagttattaaacttggatggagactggttttcttcagcactatatattatgatagtgaagcttatattatggtagtaaagtttgttggtcatgtggcttgaagctctttgttgcctattgctcatatatttagttgtggctcatatcaaattgatgactatggtatttttaaagatgcatttaacttttgttgtaggctattattagaaaaagttttaagcactacatattaggattgtgaaatttgtagctcatgtggctttggagtcctctttttcctattatgtgtcgatttagcagatggcgtgtatcaaattgatgattatggcatttctaaaggtacatttaacttttgttaaaggctattaatataaaaacaatctaggctagtagctaaattggagagtatctattttctgtcgaggctagcactatctaattgcttgcaggatgagcaaattccacatgcagaaaaaaaaaaaaagatggtggatagatctttatctgacatttcttatgaagcttagttgcatttttttttttctgaatcttaggtatcaaaatacttgacattgttaatccttggagatagtctcaacaatagcatgcaaacaaaaaagaaagaaggagaaaaagaaaaagaaactaaaaaaaaaattcttgcaaatggagcactcattgttattctagaaaaagaagaaaaaaaaagtactacatgcaactccttgtgatcatactgatgatatgtaccttgcaagattatataaccattaatgttttattaatatcattttttatttatattttcattaaaatttcattcagcatatctaccttagccagaaattttatatgcctatgagtttaccctacagagtttcggtataatatacaatttctctacattaagtctaatgcctaggaagttgtagtacatttactaatatttaagatctgtaatgcttttctaaccactcttttttttgggtccgtctaggtttgttgtattcttagatacattttccgttggtcttgatgatacaacaaccacatcagcagctgcaatgacaaattccgttcctgtggtaacctttattctggctgttttatttaggtatgatttgatcgcattaatgacgagtcgtacctgtttttttcttttcttttcttttcttttttattggttgaagtggtgtctagaactatacaaaaacatgacatctaatggagtcagcaaacaacaaatccctcggtaggagcattagacaagtcccatgaaacagaattagtaggttggacaacatgggaacatatcaagtcctaccaattttaaagatcaaccaactatgaggatttcttctttaaaagaaaaggccaaaaaaaaaaaaaaaacactattgtgataatgtctatttttgggaaatactgttgttcatattgcgattgcaagatgaaacgcatgagttggaggcgactaaaggtggatagatatgactacaaccccaagatgtttgagtcttgggtcttaatcatgcctgtttgcctttttttactgggtgattagctaaagcacaatatattattgaaaaatgaaaaagtatgtttgggttgcatctttcatgcaaaaagaatgatccattttgcttgtgacgtcaaccattgcgtcacacgacagccactttaaaaacctgcatgaaagaaaaggtggaactgctttgagagctgtgagaagcatgatctagtggttgatgtcgtaaaagaagaccaattattctttcgtacgagagacacaacccgaacccatctcaggttccaggcatagttgagagacttcacaatgcaagctaatgaaattaatttaaaactttagtagccagattgtgaatattaaatttgttgtgtttattcatgtatgcttgtcattcaagcttgttaatcataaaaacaaatcttttttaaatttgtgaataatcataactgatgttctctgtactctagattcggcacctttttttaataaagaaaactcactcttcaggaaaaaaaaaacagagagagagagagagagagaaaaatcagtatggttaagctcaccactttataattgggccacctcgcttctctgtttcccaatgaattggacagagtccgctggctggaccatcccgccaagtggaagtgcttctgggttccaaacttgaagcctttctcctccaaagcatctcgatcaagacattttcaaattatgactctcccctccctttttctctatttttttaatttattgaggtaaagagagggaggaatatccagataataattacctatatcctaatttttggagatgtcccaccaaaacatttgagtctagaatctttggttgctaggcactatatcaaaataagacatccaaacacggggggggatcttttcggtataatttagatgtgccgagcagcgcgtaacatgccttttcttttctttttctttttttttcaaaaaaaaaagagcttgtttatctttcttgaaagaaatatatgtttatccttggatcttaatcatttgtcatcattgtttcatgatagaatagaaaccattaagataaaaaagcttcagggcattgccaaagtttcgggactagtactctgcctagcaggcatcctgacgatggccttctacaagggaccccagttgaaatccttccaccatcatcacctccttggtcacgaagcgagtcaaaccgatcgaggtcactccaaatgggccttggggaccctccttatgaccatttctactacagcattgtccctatggatagtcctgcaggcatgcttctaagctttaagcaccaatgtagcataatttgcaaataggactaagaacaggcctaaaaaatttggttcaatcttctgttctcaagagagagtgatttaatttccactagggatatgtgttggaggagtaccctgccaagcttctattcaccgctcttcagtgtctctgtagcagcattcagtcattcttcatagctctagcatttgagagggacttttctcggtggaagttgggcttcaacatgaatctcctctcagtgacttatggcgtaagtgtttttcttttcttttcttctattaagatatttttcctgtgcactctttgttccaccagagcccatcttttcttaagaaatcatggcgtagaaattgccaaaccttcctcacagaacccgcctaaagctttcagatcataaaattagcgagagtaaataaatttagcgaaaagaacaatatcttcagggagaattgaattgtgcggacggccggctctagcttagctattgcacccctacattagaaacaatgcctttctatgtgaacacttgatttgaggttaaatgtagagttaagctacatgactcaaaaactttctgcaacactacagcttgtttataatgtattatatcaatttgcttctcatgctttatcgaaaaaagaaaatctgaactacttgtgtttggtgacaaaaaactaataatggaccatacgtaagcatgccttgatatatccctcatcttaattatttgctgctacaatttgatcaagtgatgcacgacagggtatcatggccactggaatgacattttacttgcagtcatggaccattgagaagaagggccccgttttcttggctatgagcacaccactgactctaattatccaaattatatgctcctcttttcttcttggagaagtaattaatttgggaaggtgtcctccagcgcttcatcaatttcgcttttcatattatactatcatgcttgaaagaaaactttactattgtcatatgtcgttgcagcattctaagtgcagttctcatggttggaggcctttacggtgttctatggggaaagaaaagagaggaaaaggatagaaaaatgcaaataagggataatgaaaaagcttgcttggaggagaaagaaacagcaattccagcacaaggaatactagtctagacaaatttactaaatatgtatccaagtcaatgtgaacttgtagctagacatttcagtactaggaattatgcgctgctgattgatgttactgccaaaagccgaaaaaagatagttatactaaaacatcttgctgattgtgatattctatttccgtgagaaatctcgttcagtagttagttagcatatccaagaatttttcctacccaatccaacagtatatccagacggtcgcaaatcaccataatattcacatattttgtccttttacctaaagaaatttcatgcatgttcattgtatttcccccaaccccacctagttatgaaaaatgggcagaattcattgcaattcctcttctcgtataatatgataaattcggtttgacaaaatagataaataaagaatgtattatatcaattcaagggagcagaaagtaaaaacgctgaatcaatacaaagatcgaaattttaacaggcaggggaaaaggctcgccataatgaagattagtaacacaaaattcttatcgatctttaattttccgtgcctttggctatacagcacctgaaacaaaagatgaaatgaaagaacgatgaacaaaaaatacctcatccatctcctaaacagcaaggggtaaagtttcaatcttgattgcatggcttagtctccattcaagaacccagaatacatcaggtcttctttcgctgctagaactattattttttttagaaaaaaaaaaagaaaagaaaccacatacccagttcaaaccgaagaatccattcaaggggcttcatactgctcagagagagcgtgacggttcccagcatgtcgagctccgtccttcccaatccaacggagacttgatcgaagatatcttggagacctttgttatgagtcgcttgtggcgatgacttaagaggacttgatctaaagcaagtgggattgctataaaatattttgttcttttttctttttcttttttttttttttttcaaaccttctctctacccctcccggtccccctcctcctgttctccgtaataccgtccccctccctctcttgtgagaggtgcgagatcgtaccataacggcggccgctaaaagatgacggccacatctcgatggcgatcaggatcacccgctttgcgatggatccagcatgaacatgtttttttctttttttattttggttactaagcaatggccggccatggtaggcggcggcggcggcggcggcggcggctgggtataggtcggcttagccaattactgtgtctactccgtaattaaaaatcatatctccatatccatcccatcactcttaatggatggggtggattatagcagatcggtttagatagataagttggattagattggattgggtgattatagattttaattataattaatgagattcaattgctataagagaagattatagcttattatcctgtgacccaaattttgatttaggtagggagaatcatagagcacatcaatagctatgatatgttctaataaaaaaacagtctatacataaatcaaatttatctagagcttagatacaaaataaacaaaggtaactgactttatgattttcatagaatatataatttttttaagttttcacaataataaatttttacataaaaaaaagggagagataatcgaggtgaaataggttatgatggttaaaattatattatatggggttagattcgaaattggacgtatcattatccgtttctgactaaaatccacttcggatattatatctaaaatctatatccatcgtcgagtttaaatagtgcaaataaaatctgttctatttatgttagatcagatcaaaaattagatatctgatggatcagctaaaattactatccttaatgttgatctttttccaatcgaccgacgaaagatagagtagatcagtaaggaagataaagatggagatgatgatttatgatctaactcgctaattcaatctgtgaataatctattttaaacaagttcaagtttgacacaaatcagtttgggtcataaaatgaatcaatctgtctcgatttatttattaaatggattgagttcaagtttcaatctttgatccgtttaacttattttaatttatttaataattgaaacgaatcacaacccgacccttttaatctatttaagttttgtttaacttatttaaaatcttcttatcatgtttctatcctatttaatccgatcagcttaatcttgatatgtttaacctatttaaatatatttaatcaattaaaaatccatttaatcaatttcatctatttaatctaattttatttatttaataaatagattatataaatatgatcaaattatttatttaataaataaattatatttaaatataaatttttgatatatttaataaaaagatcaagttgatgaatatttgatcctatctgcatctgatttaactcatatccaatttgatttggcctgattgtcagctgtcaatgaagagctatttattcgtattaggttattcaagttttacccccctgcagtcacaaaaattacgtcaccaccttcaccctgaatcgtgcaaaaattacaactgtcgacgcccttggattttgtccaaagttacagcacttgcccctcatacttggactttgccaggatataatcagttgccataagagaaatcaggatctctcattttacaatgaacggtaggcaaatattaaatagaaattcttgcaaaaattactgtctactagaaccatttcacgagtgaacaaaggagcgtgaccgaagcacatcgattatgaagtcaggccctggactgggttcgtgcctgctcttttgagtcttataaggtggatgcatagatctagcaggagccctaatcaacatcctggatgcctgttctgtcgaaccaatcaacagcttccacttactgtcataccttattacatagtagagctaatattgtcagctattcatgtattcttatgatagtttgattctttgagcataaaatgcttcaagttcagcaatatgaaaaggccaatatatgacatgattccgttgaactagcaagttatgatgttcctagaaaatcattgatatgcaatttgtagtacttaatttaacgcaatatggtataatttcatggagtgcatgggcttctgtcgtattgtcaaaatgagcacgtgcattcttcaaaataaataagccttcatggatggtgacttgagaactgtgatttcgtgggcaaatggtggaaggcctccttgagaacttgctcccatcaatggacgctgccagaaagggtggactattatccaagcatattttacagaataacaacaactagcaaactccccctggtgcttggaaatagtcaatctctacatagagatttctataccttgtgcacatgtttggcaggactctcagtgcccaggcctctatattttaattttttcatgctctgatcaaatatatatatatatatatatataatttcctgataggttttatgatgaagcctgcaccctatttacttgccatcataccatcccatatagttcaatttgctgaaattgatcttctttcaggtgacactgctgcagtcagtttttatgggtagctggagccttgttttctatgaggtaactgctttacataatgacttgaggctgttgacacttcagtgaatcatggttggctaatcttgcagagatgctcttcaggttgtcatgttgacattgcgatatttcaggagaaatgtttgtttttaaattttaaatttttcttttttttctcccttttaagactggattgcagctcagagatgccaatagtttgatagaactgacattatttttgtaacgatttctctgcctcttatagactatatgttattgcttttctctgcgcagccacatagctgccacttccctaataacgaaagaacaaaattgtattcaggcaattcaagtttgctctaggatattgggaattaccttttttttattgttggtctgtgagaaatgatggtcttgtggaacttattcctcatgtactaacggcttttcagagacaataacagaaaaagggagaggacccgattacagagaatctacatagaaatcatggttaacgcaatccatttgtaattaatcctgctgactatttttggatgaatattttgaaacaaaagtatgcctagaggcagctgttcagataacagttaaaaagatgctggctcaacttgtttgcatgcttcattctcttgatagtgtgggttagaagttctacaaggagattgattgcaaataaaattgaaataagtaaattgcctgttgttctgatcttctgaaaatttattcatgcaatcacatgtagattcttgaacctaggatccgtataactggagtaaattatgcaattatcaaactacaaaaaaagaaaagaaaaagaaaattatgataccactggaatgtatgctaatatgatacaaattagtctccaccacccttggttgaggtcttgagtctcaatggctaaagtgctttatgtataatttttgcttaatagtttgtttatcatctctctccctctctctctttatatatataaagagagaaaggggggtttgattaggatctgatggtgatatttactcagatcagtcgtatcagtattaaaaaattatatttaaaattatttatatatcaaaaattatataatttagatatgtgtaatctatatatcaaataatcaaaaatttggattgtttaagtttaataaaataatatatatattttttaatcatttgacatataaattataatttttaaatcataaaatttcttattatataaacaatctaaagatcaccttaaataatctggatcatcaatactgaatcaccatcgtctaacatcggtcccatcgaatttgaatggatgattgacgtgtccggcactagccttttttctttttccttttttgataaagagtccggcactagcatattatattaggacacgcaaagtttggtgtgcagatccaatggtagattctacccactaatttctctgcttttgtcatccggcaacccttcagggcacattatcttactcaataatattacactatctaatgttaaagtgtcatcaaatagatttggctttttttttttggtaagaaaaatagatttggctttgttggccagttgggatgttaggaatggacttcgcacatagaatcaaggatccaaacggggaaaaaatgaaaagaaaagaaaaggtatagtctagaatctaagacatttagatataaaatgaattccgaaattcaactaaacggattgtgacaaggtctggtccattaacttggcacagggagagtcccatggatcagatctactagtttgaggctttgcaccgtggagtataggtctgttctctctctctctcttctttcttttttttttgagaaaagaggatcaaatgttccacctactccattaagactatgaacgaagagcaaaggaatacagatctgcaatattgagttggggctatgtcaatataatgctggatttgatatggctttgacttataaatatgggatggataagtggatctactgttatatggctcatgggatgagcatgcagatactcggggcatatttggttgaaaggagttggactctacgatgagaatataaataagtaactttcattccaattatttagttaggaggagtctcattctcatttcgattctaaagaggaatgggaatacttcaatccttcaaaattcaatttatactttctcctagtgttcaaattttattttaattctagtcacacaccaaaaatgatggataatatggttatgtcaatttctatttcaatctactttgattttgattctatttctaatcgagaaataaatgcaccccaggatttgatgcttgtaaattgatggccttaatagtttagtggttttgagagtgtagcccatcttatgctggctttaccatcaaaaccccgtcctgatttaagtctctgtataggacaattcttgtaatgatgtccgccttgaagaattctataaggcaatggttggtgaaccttgggacaaaaattttttgatccgtgcacaatagaaaatcatatagagtgggttttcttttttaccatatctaaaagccatattgagatgggactcttcttgtcagcgaagtctactcatctcataatttttttgaaaaaaaaaaaattacagtacacttgtgaaatttgaggctgtctacttgcctgcatttttttttttttttctggtcatcaagtttctctccaaccattcataagaagttcctcctctgcctatccatagggttttgattctaataaaaataatatattttgaggattgcaaaagttttgcattcttttttctaatataaaatttgaaattatgtgatacagagtttaggttaatatacacttgatgattggctcatatatattttaagttttttgatacatacataacaacatctccatcacctcttaaaaaaaattggtgcacaatttttaaaatataatattcattaatatataatatataattagataatatatatcttacatattattcatcccatatctcaatacacatctctgaaaaattgatatatgatttctagaatatcatgtttactgacacatatatacatatatacagttaggtaatatgtattcattagctttcttgatacacactataagtttttttttaatacatacttaataataacttagtacatgccttcaaacaaatcgatatataatttttagaataacacgctcatcgatatatagtatataattaggtaatatacattcgtctgctttttagtatatattctaaatttttttgatatatacttaaattcaatacaaatctccgaataaaatgatacatagtttttgaaaaatgaaattcactaatatacaatccacagttatataatacatacctaacaaattaattatttgacaatctaacgtacatcttgggatggaaagcttaatggatagatggaaagaggcttgatgaaaagagatagacggcctcaacttttcatacatatatcattaattttttgtttttttacaaagttatgagatggacatatgtatgtactttattcgtagtagaagatctgactcttgatttgccacatcaagatgcatactataggagacatgacaaagaagaaagtccattctaaatgattttctctagcatgtgcatcagaggatttttgtccatgaactttatcatttctttgcaccaacataaacgagaattttggtacagtatatcgaatgaagttggtgtgctttatgatacgtgatcaaatcatcccacattgcaccagtatatctgcacgaaggaaaacggggcggcattggtgcaccacgaatggcatgcacagaaagaaagttcatggagaagttatatactatttttttgttttctatttctagttgtcacctatggacttccagcttgatcaccaatacgaatagtgggcattattgtcaactccacgactttctttcggtttttttcattttctaaggttgcatatgatatgaccataaagaaaatgagaatataaaagcttatccgagatatttatgctaaaatctatttagttattaagttttagaataaactgaaaattaaaattttcataggaatattgatattattatgttaataaaatatttatattataacataatattgtaatataatactatatcatatcaataagattataatattagttcgatagcaatacaataaatattggatatttattttagctttattatagtaatattgttctaatacaatcatattattaataattatcatagaatacaatattatataaaatattatagtataatataacataactataatattgtcatattttattatggaattaaaataattatgatatttttgttagtagctctctcgatatatatatattattgattgtcataatataaaattaatttcagaggcataatctaaaagtgcgcataaagaattaggcacgtgttgagaccgattcagaaatggaatagattggcctagaaaaatggacatatgatatagtttgattgggcaagcttattctaaatctatgatcattttatcaacaaaaaaaaaatctatgctcaatttataaataatacttggttagcataaggctcaattgtaggttggctaagcaagcaatagggatagagtgcctaaaaatttttattaattagaaaaagaaaaaagagattagagaagaacaaaaggataaaaaaaaataataataacatccagaagccaaagaattgacataaaagatacttttcgctctaatctttcttagaaacaattactcaacgctagatttcttccatctctatctcacgcacagaacacacatacgctaatctgttttatttaatcaaaatatatttaatgggatatttgacatgttagagtgctgctggtgagaaggaatcccatcactttaagatcaatgcatttctagtgggccatctaagaaaggtagcggaaagattccatcccactcacaatagcgaaaagaaaagaaaagacagaaaaaagcctaagagcaatgcataattctttaatcataataattatttgaagcacatggaaggagagagataaaagagcctttcaattccaagcgaatacctccatactggtgcctaaggaggctccatttttatttgatagttggacttcaaaaacaaaaaagccatagttgaaatatagagcatagtatgtaaaatattaggatctctgactgtaaatagaagggagaaaaatgcatatctcacaatcataggaaaacaaaaaaaaggagacgagtctaagcaaacacctgtaacctgagtaggcactttattctaaatattgcgtcagcaacataaactcttttctgtgtataattcctaagttgacatctgtatattattggaaccatattctcaagtagttcacagcacaaacactataaatgcaccctttaataagttaccccgtggcctatgcctcccattgttatcagaagaaatatataattatctttcaaaaatcactattgcatgtgcacattagattatccttcttttaatacaaatattcctctcattagatttttggttgacaatattaataaataatattttaaatataaattagttgattacctttttgcatcaatattcttacaaaagtttatataaaagcatagcccttcttgatgcaaactgaatgttagattgcttagaaatattaatgtaaaagagtaataatatgcttaaaataattatttattaatgtttccggccaaaaagctaacaagagaggatccataccaaaaaaaaaaaaggatagtttgaaagatatacatataaataataaattttggagggtaaatatgtaataatctatttttgcaaagataactctacatgaaaaatctaaaataaaaactataagacaaagcctggcccaccgccagctttttagtctacccgtttaagtttaggagacaaatttctatatgccgtcccatttatccctctatatatccatccttcccgtccagattccagagaagctctaacccaactctagtcatggaggacatgaaggtttatgtggtcatctttctcataagctttatatatgcggtcatgcagattcttacgaaggctgccttcgatggaggcatgagcacattcatttatgtgttctataggcagcttattggcaccctctttgtgtcaccagttgctttggtgcttgaaaggtaatgattgctccattctcttccatttgatgttccattagtttctcgttgacatcttctgttatttaggaacattgctcccccactgtcatttaaggtctgcttcaagattttcttgcttactttggtggggtaagttgtttcgaatctaattttatgttcaagtaaaaaaaaaaaaagagctagtttcttttggatgtcaatacattcataattgtacctatattttttagtaaatataaatataattatggatattaaatagatgtaaatagatatgggaatgaattggatatcaagtatagttatatatttattttaaataaataaagatataaagtcaaatattattcagatctgaattaaatttttaagtaaaatttaataatgaaaataaatataaacaatctcatcataaacgatggaaatgaaattcactatcacataatgaacagtaattaggtaatggtctaagaggtagttattggacagactgattttcttgagcactatatgttatgatagtgaaatttgttgttcatatgatttgaaagtctcttttgcctattgcttgtaaatttagctgcagctcatatcaaattgatgactatggtatatctaaaaatagatataatgcatttaacttttgttgtaggctgttattagaaaaagttttaagcactacatgttaggattgtgaaatttatacaaacaatagcatgcaaacaaaaaggaaagaagaaataaaaaaaaaaactcttgcagatggtgcactcattattattctagaaaaaaaaaaaaagtactacatgcaactcctagcgatcatactgatgatatgtaccttgcaagattatataaccattaattttttattaatctcattttctatttatatttccattaaaactccattcagcatatctatcttagccaataattttactgcctatgagtttacggtccatagtttgggcataatatacaatttctctgcattaaacaagtctaatgcctaggaagttgtacatttaccagtatttaagatttgtaatgcttttctaaccacctttttttggtccgtctaggcttattgtattcttagatacatattctgttggtcttgattatacaacaacaacgtcagcagctgcaatgataaattccgctcctgcggttacctttattctggctgttttatttaggtatggtttgatgacattatttaaaaatcctacatgttctttttttttttttattgattgaattagtgtctagaattatacaagaacatgacatccaatggagtcagcaaacaaatccctcaacttagtaggagcattagacaagtcccatgaaacagaattagtatgttggacaacatgggaagatataaagtcctaccaattttagagactaaccagctatgaggatttcttctttaaaaagaaaaaaaaaagcccactgtgatatggtctatttttgggaaatactgttcatattgtgatcgcaacatgaaacgcatgagtcggaggcaactagagatggatacatgtgactacaaccctaagacatttgtgtcttgcgtctttatcatatgcgtgtttgcttttttttaccgggtgattagccgaagcacaatatattgttaaaaaataaaaaagtatgttttttttgccaaaagaaatgatttatctttttcatgacgtcaaccattgcatcacacaatggccacttcaaaaaccgtacagatggatgaaaaaaagttaaaactgcttttgagatccatgagaagcatgatccagtggttgatgtcgttaaaaaaaaattgatcattcttccgtgtgtacaacccaaacacatctcagcttctaggcatggttgagagactttacaatacaagctaatgaattaatttaaaacttcagtaaccagactgtgaatattaaatttgttgtgttcattcatgtatgcttgtcattcaagctcagttgcaaaccataaaaacaaatcttttctaaatttgtgaatgatcggaactaatcctctctgtactttaaactcagcacctttttttaataaagaaagctcactcttccaaaaaaaaaaaaatcactgtggttaagctcaccactttatagttgggggctaccttgcctgccgtgttctctgtttcctaataaattggacagagtccactggctggaccatctcaccaagtgggagtgctcctgggttccaaacttaaagccttgctcctccaaagcatttcgatccggacattttcaaactatgactctccccttcctttttttttttttttttttaattattgagggaaagagggaggaatatccatataataattacttatatcctaattttttggatatgttccaccaaaacatttgaacctagaatctttggttgctaggctctatatcaaaatgagacaatccctaagtcattcaaacaccaaaaatatgcttcctaatatatttttttgggtacaacctttccagtataatttagatgtgcgtagcagcccatagtatgccttttcttttttttttaaaaaaaaaggagcttgtttatctttcttgaaagaaatatatgtttaaccttagatcttaatcatgcgttatcattgtttcatgatagaatagaaaccattaagataaaaaagcttcagggcattgccaaagtttctggaatagtactctgcctagcaggcatcctgacgttggccttcttcaagggaccccagttgaaatccttcaaccatcatcacctctttggccatagagcgagtcaaaccgatcgaggccactccaagtgggccctggggatcctccttatgaccatttctactacagcattatctctagggacggtcctgcaggtatgcttctaagctctaagcaccagatttcccaattattcgagtcctctggtcctgcagtttatcatataaattagattaaggtagcataatttgcaaataggactgagatcaggcctacaaaatttggttctatcttttgttctcaaaagagagtgatttaatttccactagggatttgtgctgaaggagtaccctgccaagcttgcattcaccgctcttcagtgtctctgtggcgccattcagtcattcttcgtagctctagcatttgagagggacttttctcggtggaagttgggcttcaacatgaatctcctctcggtgacttacggcgtaagtatttttccttttcttttcttctcttaagaaatttttcctgtgcactctttgttccaccagagcccatcttttcttaagaaatcatgacgtagaattgccaaaccttcctcacagaacccgcctaaagctttcagatcataaaattagtgagaataaataaatctagtgaaaagaagcagaattgaatagtgcaaactggcactagcttagctattgcaccccttcattagaaataatgcctttctatgttaacacttgattagaggttaaatggagagttaaggaagaagactcaaattaagtttctgcaacatagcttgtttgtaatgtatcatatcaatttgctgctcatgcttgcgtaaaggaaagaaaaatctgaattacttgtttggtgacaaaaaataataatggatcactaaagcatgcgttgatatatccctcatcttatttgctgctaaaatttgatcaagtgatgcatgacagggtatcatggccacgggagtcacattttacttacagtcatggaccattgagaagaagggccccgttttcttggctatgggctcaccattgattctaattatccaaatcatatgctcctatgttcttcttggagaaataattaatttgggaaggtgtcctttagcgcttcatcaaatctgcttttcatattatactgttatgcttttaaaggaaactttaccattgtgatatgtcgtcgcagcattctgagtggagttctcatggttggaggcctttatggtgttctctggggaaagaaaagagaagaaaacgatcgcaaaaagcaaataagggagaatgaaaaagcttgcttggaggagaaagaaacagcgattccagcacaaggagtactggtctaaacaaatttactaattacgtatcgaagtcgatgtgaacttgtagctagacacttgatgtaacagctaaaaataaggctggaaccggatcggataccagcatatccatatctatatttattttatctgataaatataaatatggatatggatattattcgaatgtaaaaatttatatctatatttgttttaaacggatatagatataatttgaatactgaaatatagatataattatgaagataattatgataattaaattttatgactacaaaatcaaagatattattaaatagatgataaatcaaattaataacatatttacgtgaccgtatatttttcttaaaaattaattagtgctatataaaatttatagaattatatgtagatatagatattttgatacggatcgaatagttgtctatccatatccatatctatttttcttcgacggatatgaatatggatatagatattaattggatcttaaaatttctgtctatattcaaaaattaattaagatatgaaaatagatccaaatgaataatatttatatcactttcatcttgtaccctaaaagatcttggtgattgtgattttatattcccatgagaaatcttgttccgtaattagtttctcggcagtttttaactaacccattcaagacatgatctggcgcagggatgaaaatatccaagaattttcccaacccaatccaacactatatccagacagtcccataatattcacaaatttcatcatgcacgcttattgtatttctcccaacctcacgcggttatgaaaaatcgtcagaattcattggaattcctcttctcgtataatatgatatattcggttggacaaaatagataaataaattaagaatgtattatatcaatttaaggaaacagaaagtaaaaacgctgaatcaatacaaagatcgaaattttagtaggcagggaaaaaggctcgccataatgaagaaaagtaacacagaattcgtattgatctttaattttccatgcctatggctatgcagcacctgaaaacaaaagataaaatgaaagaaggatgaacaaaaatacctcatccatctcctaaaaatctgattgcatggctcggtctctgctcaagaacccagaatacatcaggtctactttcactgctagaactatttttttttcaaaaaaaaaaatacacataccacattcaaaccaaagaatccattcaaggggtttcacattgctttatgagagcttgacgtttccaagcatatcgagctccatcgttcccaatccaacgaagacttgaagagatcttggagatttttgcaatgagtccttttgtggcagtgactaaggatgacttgatcgaaagcaagtgggatttgttttgaaaaagatccgtcaactaaaccaatcatctactaagatgcatctaggatgatatgatcacatcagacatggatccaaaatcatcaattcggccagccatacgaatgaagtctgtatttgacactcatgattaataattttggttcaaaaaaataaaatttattatttttattcaaataattaaaatttgctcttggttattgaaaattatcattttttattgttggttgcactatttcattgaccatcaaagataaaaagccagtgctcgtacagattttttaaaggtgcaaatccagatggtagaacgttctaaacaacaatttctctgcttcttggcaatggtgcgctgtatccggttgccattggacaaccgtttagggcacacaatctcactgaataatatttcactatccaatgttaaagtgtcatcaaacgaattcggctttgttggccagcagggatgttagtgtggactttgcttatagaatcatggatccatcctgttatggtcaatgattggatagtttgaatggttggatcaatctccactttacatgtgtgaggtattgtgtgcttcagttctgacccatctcgaacttcaatggaccctgatgattttagtgggtcatgactatttggagcttcatgattttgccctttaaaagatacttcacgggggagagaatgtcccattctatataaactaaagttttccttgattcaatcggatagttggatcggtctctgctcccacatatatgaggtattgtccccctcaactttaactgtttcgggctccggtaggtcttgacatttagagccttatgattttgtcctctaaaaagcacctcagagaaggtcccattccatttaaattagagtttttcttgactcacgactgacatgagatcaaaggtgtcctcctctcacaatatatccaaaatggtgataaaagaaaagaaaagaaaaggtatggactaaaatctaagacacttagatacaaaatgaattccaaaattcaaataaaagaattagtacaaggtctggcccattaactcacccaggaagaggcccatggatcagatctactagtttgaggctttctgctgtagaacataggccaatatttttttttttttttgattatttttttgagaaagagaggaataaatccacctgctacttcaagagtacgaatgaaagagcaaagaagtatggatatgtaacactgaattgggtttgtgtccggatccaaccatgccaagctctatatggtttccactcgtgaatatgcgcggccgagtggaccctgtgccataatataaaattatattatattatattgatttcaataaaattaatttatattgattgtcataatataaagttaattttaaaggtacaatctaaaagagcacataaagggttaggcataagcctgtttccagatggatatataaatagaataatttattttaaaaaaaaggactcacgatagtcggaccgtgcatagcctattctaaaccactgctcatttcatcatcaaaataaatcggtgcttatttcatgaaaaatatttggttaacatgagactctattggaagtcatatgctccaatcggctaagaggataataaaggtagaatatctaaaaattttttatttattaaaaaataaaaaaaaaagaaaacagagaaaagaataatagcatcctccagtcaaagaattaacgcaaaagggactcttcgctctaatctttctgaaaaagaattgctcagcggctagatttctttcccccctctctctctctgtctctctctctctcacgcgcagtacatacattcgttaatctgttttatttaatcaaaatatttttcaatgaatgtttgacatgttagagtgctgatagtgagtaggaatccaatcacttaagcttccttccaccctttgacacttctgctgggccatgaaataagcaatctcatctgtgagaaagctagcagaaagactcaatcccacttacaagtgggaggggagaaaaaacaacaatatcctctgcagggcaaaagtgcgccttttgaagtgtcacatcgtcctgcatggccattacgtagcgtagctagcggtaccatagtgtacggtaaaaaacgggtagctagcggtaccataatatagggtaaaaaaacgtgtttacgaaagaatgaaagtcaatatatatatatatatatatatattattatgattttgaagaggacactgataatttgacatctattgtgaatcaaaaaaatttatatatatatatttttttacgtgagatattttttaagagataaaattatgaagcccataaattagagtggataataccttacatgatggatcgaatctttgttcgtaacaatgatgtgtcagataggaattgaagtctgtctcgactgattgtgaggcttctcggaatgtatacattagagttttctttgtttgagggacacgaataattctacatcggttgtgagtagaggaactcgtgctcataaggagaaaatttttttttttacatgaggtgcttttaagagacaaaatagtgagatccatggatcaaaacggacaatacttcatgtaacgaactgaacttttgtccgcaatatatatatacatacacacacacacacacacacatatatatatatatatatatatatatatatatatatatatatatatatatatatatatatatatatatatattatnnnnnnnnnnnnnnnnnnnncatatttatctttcaaaaatcatacacatcaaattgtctgaatatttctatcattatatttttggttgacggcatcagtaagtaactattttaagtacaaattacttgattacctttttgcatcaatatccttcaaaattttatataaaagcataactcttctcgatacaaactgaatcttctttgaaactattcatgtaaaagagtaataatgatgcttaaccaaaaagctaacaataggatccatacagagaaaaagataattatgtaataatagattttggagtgtaaatatttaataaactatttttgcaaggatatgtctacatgaaaaatctaaatacaatctataagacaaagcttagcccaccaccagctgcccccgctttttcctcaacccgtttttgtttaggagctaaatttctatttgcccccctatatatccatcctactatacatccatccttcccgtccagatcctaaagaagctctaacttaactctagtcatggagaatatgaaagtttatgtggccacataaaggtgactgccagtcttctcgatctcctgttgtctcgctggaatgtggaagctgtgggtgatatcatctccggttttggtgttcccctacatgcaagccgagctagcactcgttgggaagatctttcaagtttcgacgtccattttttatgcgaagatgttgataccctgccggaagtaatcgacgtcactgtgggtctcctcacctttgaagttaagcttcaaattaacttcttctgtcccttcatttatttgttttataggtagctgattggcactctctttgcggcaccaattgctttggtatttgaaaggtactgattggtccactcttttggattcgaccctccattattttcatgccatcactggcatcttctgttatttaggaaaagagctccgccgttatcatttaaggtctgcttcgagattttcctgcttgccttggcggggtaagtttttttgaaccaaattttatttttaaatgacaaaaactttttttttttgatactgacacatttacaactataccaaaatttttcattaaatataattataaatatggatgttaagcagataccagaattggcatgtatatttattctaaatgaatatgcgtatgagttggatactaagcatattcatatttattttaaataaataaagatataaatcaaatattatttggatatatattaggtttttaagtaaaatttaataataaaaataaatataaacaatctaatcataaagaatgcaaatgaaatccaccgttaaggtcccacatgataaacagtaattaggcaatggtctaagaagtagttattaaatttgaatggagaccgattttcttaagcactaaatattgggatagtgaattgttgttcttgtgacttgaatgtctttttgcctattacttataaacttggctgtggctcatgtcaaattgatgaatatggcagttctagagatacatttaacttttgttgcagaccgttactagggaaagctttatgcactacatattaggactgtaaaatttgtggttcatgtagcttgaaggtccctattgctaattatatttagatttaggatataactcatatcaaattgatgactatgtcatttctaaagttacatttaacttttgttgtaggctattattgacaaaacaacttaggctagcagccaaattggagagcgtttgttctctcgaggctagtgctatctaatttcttgctggatgagtaaattcagcatgtagaaaaaggtggtagatggatcatcatctaatattgctagtgaagcttagctacattttctttctttgaatcttgagaatcagaggcatttctctatgtatttgataattattgggatataccgaccgaccctgatgccgactcaccaacgcccaccaccgacgggtcacgacgccgatccgtcctcgacaccgactcaccgatgggtcccgatgccgacccatccacgaggacggaccgaccgatttcgcccgaccgacgatgggcaataccaacagtaactgccgatcgtgccaggccaggacggatcggcctaacgggccaacgccgcctccgatcgcccgaaagccgaccccgacggacgaccgacggacgaccccgatggacgactccgaccgacggctgccgacaatatccgaccgaaggtgtgtcggccgaacccacccatgctattcccgaccgaccgagcggtcggaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccggatcatcacccgatgtctcgacagtcgaataccgacgtatgatcggccagccctcccaaataccgtacgaccgctatgggctgttgtcctgtcaaggacgtgccgtgtgattgctctggaacattgtcctgccaaggacatgggttgattctgacaacccgcggtgatttgacagcccacgatgactctgacaacccgcggtgatttgacagcccacgacgactctgacagcctccgacgatttgacaactcctcccattgtctgcgccattaatgatggcgccatgccgcgctctactataaaacggagaaggcaacagtgctggaagaggtcccttcgaaaaaactcttgggcttgctccctctctctctatccccctctcgttgagctccttgttctcttttcactattgcctagtctcctctctgacttgaccgtcggagggtccccgccggagccaccttcagtcagtgtggactttcttttgcaggcgctcgttcccagcgaccaggcgacgaggggattggccgcaacagattggcgcactaggaagggggcccagcgtagtgcttcatcgacagcaccagggattgcaacccccacagaactagaaacatctccccagatgacaaagacaagagctcaacggtcgagggtcaccggatcggcgaggcgttcttcccgccgggaagaggcctctcctccaccctccatggtggaacttagttccccccatcccgcggtgaccacggaggcgcagattgcagcgatcatgcggcagatgaccgtgttgacagacgcggtcaagagccttcaacaacaaccaatccggctgccgcactcgccggtggagcaaccgacggcacacccgatgccctccaggagcttccgaccggtgcctgacctagggcacgggccggaagaaaaagcggaagaaaggtcgggcccctgctgaacccagcaggccccccaccgatagacaggtctcgtcccgacaacggagtctgagaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacaccaacagtaactgccgatcgtgccaggccaggacggatcggcctaacgggccaacgccgcctccgatcgcccgaaagccgaccccgacggacgaccgacggacgaccccgatggacgactccgaccgacggctgccgacaatatccgaccgaaggtgtgtcggccgaaccgaccaatgctgtttccgaccgaccgagcggttggacccatattaccgactcactgtcgggggtggcagccgacgtccgacttaagcaagacaccagaccagccgacggtgcctccgggtcatcacccgacgtctcgacagccgaataccgacgtatgatcggccagccctcccaaatgccgtacgaccgctatgggctgctgtcctgtcaaggacgtactgtgtgatcaccctggaacattgtcctgccaaggacatgggttgattctgacaacccacggcgatttgacagcctacggtgactttgacaacccgcggcgatttgacagtccacgatgactctgacagcctccggcgatttgacaactccttccattgtctgcgccattaatgatggcgctatgccgcgctctactataaaatggagaaggcaacagtgctggaagaggtcccttcgaaaaaaactcttgggcttgctccctttctctctatccccctctcgttgagctccttgttctcttttcactgttgcctagtctcctctctgatttgaccatcggagggtctccgtcggagcaacctccggtcagtgtggacttttttttacaggcgctcgttctcgacgatcagacgacgaggggattggccgcaacaacaatgataatccttgcaaatagtttcaacaaaaacatgcaaaagaaaagaaaaaggaaaaaaagtaaagtaaagtaaagaaaagactcttgcagatggtgcactcattgccattctaataaaagaaggaaaaaaaagtactatatgttcctccttgtgatcatattgatgatatgtacattacaagattaaataatcaataattttttattaatctcattttctatttatatttttataaaaatttcactcagcatatctaccttagccaataatttcatatgcctatgagttcatcctccatggtttgggtgtaatatactatttctctacactaaacaagtctaatgtttaagaacttgcatatttacccaatatgtaagatttgtaatgcttttctaaccaccttttttagatctgtctaggcttcttatattcttaaatacattttatgttgatcttaattgtacaacaagagaagatattcgttgcaacggtgatgtcacgtcaaaattatcacaatccaaacaaaagccagaaattgatagctagtatggggcataattcacaaaaataagtgaaatacacagcactcgatgaaatacaggtactctcattgggttgtgataagttggacgtggtatgaccattgcaatgaatattttctcatacaacaaccacatcagcagctgcaatgataaattccgttcctattttctatttagatatggcttgatcacattgtttaaaagccctacctttttgattcttttcttctttattggttgaattggtgtctagaactatacaagaatataggcatccaattaacggtgtcactaaacaagaaatccctcaactcagtaggaaaattagacaagtccaatgaagtagaataagtatgttggacagcatgggaggaagcaaaattctaccagtgctaaggacttggcaagtgtgttgttcatatagtgtttgcaacatgaaatgcatggttggagacaactagaagcggatggatatggctacgacccaaagatatttgggctttgtatgtttctcacgcatgtttgcttctttctgctgggccatgagctgaagcatagtttattgttgcaaactgagcaagtacgtcatgcacttgggttcagatcgtatctttcacgccaaatgatccatattgttttatgatatcaattattagattgtgcaacagctacttcgagaataatgcaagtggataaaagaaaagttcgaactactttgagatctatgaaagattcaatttactggttgacatcacgaaagatgatcaatcattctttcgtgtgaaagatacagcccaatctcatcttggatcctatatatgtatagcaatgcaagctaatggaattaatttaaaatttaataacccgactgtgaatattaaatttgttgtgcttactcatgtatgcttatcattcaagctcagttgtaaaccataaacacaaatcttttttttttaatttgtgaatgatcataactaatcttctctatactctaaatttggcacctttttttaataaagacaactcactcttaaaaaaataaaaatcagtgtggttaaatttgcgactttataattgggctatcttgcttgccctactgtctatttctcaatgaattggacagagtccatcggttggaccatcccaccaagtgggagaggtactgggtttcaaagttggagcctttcttctccaaagcatccccgtcgaggcattttcacattttgactctcccttccctttttctctatttttttgatttgttgagggaaaggaagagaggcatatccacataataattacttatatcctaatttctttttggagaagttccactaaaagatttgatcgtagaatctttggtttataggcactatatcaaaatgagacaacctccaagtcactcaaacatcaaaaatgtgctttttaagatatatatatatatatatatatatatatatatatataataaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatatatatatatatatatatatatatatatatattcgataataaaaaaaggagaccattgtgcattagcacagtagtcaccaaactttattctgctttctaatatatattcttttgggtgctatcttttcggtataatttaaatgtgcctggcagcccatagtatgcctttttttcctttagattttaatcatgcattatcattgttgaatagaaaccattatgataaaagagcttcgagcattgccaaagtttctggactggtcatccgcctggcaggcatcctgacgatggccttctacaagggaccccagttgaaatccttcaaccatcatcacttagtcatggagcgagtcaaaccgatcgatatcactccaagagggccttggggaccctccttatgaccatttctacgacagcattgtctctatggatggtcctgcaggtatgcctctaagctctaagcaccagatttcccaattatcctagtcctccgctccaacatttgtcatataaattatattaaggtagcatattttgcaaataggactaataaccggcctaaaagatttggttctatcttctgttctcaagagagaatgatttaatttccaatagggatatgcgttgttggagtaccctgccaagcttctattcaccactcttcaagctctacgtagcagcattcagtcattcttcatagctctagcatttgggagggacgtttctcggtggaagttgggcttcgacatgaatctcctctcagtgacttacggcgtgagtatctcttttcttttcttttctcttaaagaaatttttcctgtgcaatctttgttccaccaaagcccatcttttcttaagaaatcatagcatagagatgccaatccttcatcacagagcccacgtaaagctttcgaataataaaattagtgagaataaataaatctagtgaaaagaagaatatctacaaggataattgaattatgcaaactagctgtaattcagctattgcacccctacattagaaataatgcctttctatgtgaacacttgatttgaggtcaaatgtggagttgagcaagaagactcaaaaatttctgcagcatagcttgtttataatgaatgtattatatcaatttgctgctcatcctttagtgataaaagaaaatctgaactacttgtttcatgacaaaaaataataatggacccggaaagcatgcattcttatatcccttatcttatttgctgctacaatttgatcaagcgttgcatgacagggtatcatggccactggagtcacatattactggcggtcatggaccattgagatttgagaagaagggccccgttttctcggctatgaccacaccaataactctaattatgcaaataatatgcaactcttttcttcttggagataattaatttgggaaggtgtccttcagcgcttcatcaaatatgcttttcatattatactatcatgcttgaaagggaactttaccattttaatatgccgttgcagcattctaagtggagttctcatggttggaggcctttacggtgttctttggggatagaacctagaagaaaacgatagcaaaatgcaaacaagggagaatgcaaaagcttgcttggaggagaaagaaacagcaattccagcacaaagaatacaagtgcaaacaaatttaccatccaagtcaatgtgaactcgtaactggacatttcagtaccaggaattatagagatacgatttcaaactagagtttgaattgggttcagcaattctaaatcgtgtcgctgtcgatgccaaaggtctgtttcacttttccgtgagtggatatgcaaactcagttcggtcaatgggttcatgcatttggttgacatgaaaaagtaaattgggtcccacaatggaccgatttctggagaattgacccgaaattgtttccggctcaatccactcacaccaaaccacacggctctatgttttaagacgaatatggattctaatttaagcctaaaaaattccattgacgcgtgtgtgtgtgtaatttttggtcgtatatgaaatgacaaactatgcggagtgcagaaaaagccacgcaactaaaaccaatttaagggaatagaaagtaaaaaaaccgactcctctgcggcgaactcgaggtaccatagcatgcagtggattgtgctggtacgtacgatggatgactagcaaacaacgtgcatcgtgtgtgtgcatggcttgtgctggtgtatctattatatgctagatatacatcctctgatggatggctaatccaatatatcgcacgatacagtgcaccctagaggatcacactcaaaataaagatgctgaatcatacagaatttgatattttagcgggcagggaaatgggctcatcatcacgacaacattaatatagatctttaattttccaggtcctcagctatacagcaccttaaatacaagacgacatgaaaggaggctgaacaaatatcccatcaatctgccaaacatcaggagtaaagtttcaatcttgattgcatggctcagagtccgcttaagaacccggaatacctgagtcttctttcaccgctagaattaaaaaaaaaaaaagaagaccacatacccaattcaaaccaaatatttcattcatacagatgacttcatattgctgtgagagagcctgaacgttccgagcacgtcgagctccatccttcccaatccgacggagactcgaatatcttggagacttcgctgcgagtcgccggtggcggccactttggacgactggacctaaaacagatggggattgctacggcacgttttttatcccttttttttttttttttttttttggggaaccttctctcccccactctccgtcccacacccccacccctacccctcgcggaaggtggaagaatcagacgacggctggccaagatcgccagctttgaggtggattcgacttgaacaggtttgtcggtcacgaagtaaatggccggccgacattgtgacaacaggctatcgcttttttttttttaacagaaagaataaaactatattgcgtaaatcagtacaacaagcaggttacagaaggaaaaaaaaaaaaacgccccaaaaaactgtcaaactgcataactaaatatacagctaaaaagaaacccagaaacataatattacaacaacaaaaggatggtaaggccaacattcccagaacttaagcttggaaacttttcagacaagtaaaagctgcagctgagatttcaacgccctgtaagacatggtagagaccaaaaaataagagatgaacatagcaggaaactccatgctctatatacgaggcagcagcataaaaataaccagctgatctcagagaataaaaataaaaggtcggtgggcctttttggatcggccgacaaaaggtgggtagatccacgaggaaaacaaaaagagaggcggcaatttataatccagctcgttaatttgattcaccgacaattcattttaaacaagttcggatatagtataaataaatttagatcataaatgaatcatatagattgaatttacatttagacctttaatccttttaatatgcttcaacccatctaataattaaatcagatccgatccacttaatctattcaagacttattaaacttatttaaaaccttcttaacatgtttctatcatgttttatccaatgtgcctaatctatttgacatatttaacctatttagatccatttaataagttaaaaatttatttaatctatttaataaattggttatatgggtagaatcaaattatctattcaataaattggtcatatttagatatcaatttttggcatatttaataaacaggtggcgttaatgaatatttgatccgatccgtattgattcaatccttatctgactcaatctaatcagatcactgcccctaaatgaagggctgtttactcatattagattaatcaatttttacctcctaaaagtgcaaaaattacatcatcactatcatcaaagttttataaataacatcagtcatcctcgttggattttgtctaagttataacgcttgccgcacatgcttggactttgcaaggatataatccgttggcacaagagaaaacaagatcactcatttaatgatgaacggtaagcaaatattaaattgaaatatctgtaaaaatttttagaagcaacccagcaaaacccaaaactgtttttttttggtagaaaaaggggcagatcttcattgtcaataagtaggtagttattatagaggattacaaaatcaggagcctgctaagaataaaaaagaggttgtacagaccaaaacgttaaagaataaatacataagagtaccagtaactgttagcgtcctataagatagatcaaaatagcagtgattgttaaggattagtaataataagaattgataagtgaaagaaaagtgtgaatagataagaggccaaaaattgcttgcaggagcaagagtccaccaatcaagataaaagaatctggaagtagtggcaatattgtaaaatgagcagtggcctagagtccaaaacacagcaaccaaaagatgatattgataatttggattccattctgctagacaacgcagagataattgataataccagaggatattaatatgttccatgccagctaatacgaaataactcagatgtaaggggctaagaaatcatgatgttcctagaaaatcatccataagcaatttgtaatacttaattttatgtaatatggtataatttcatagagtgcagaggcgtctgctgtatttttgagtattaacgtaatatggcatggtttcatggagtacatgggcttttgttgcattgttgcattgccaaaacaagcacgtacactcttcaaatcaaatatgcctttatggatagtgactttgagaactgtgatttcgtgggcaaatggtggaaggtctccttgagaacttgctcccatcaacagacactgccagaaagggtagaccattatccaagcgtactttacagaacgacaataactagctagcgcacccccctggtacatgatatagtaaatctctacgttggaatttctatgcctcgtgcgcatgtttggcaggactctcagtgcgcccgagtctttatattttaatttttcatgcttgcatttaaaaaaattaatatataatttttaaaatataaaatttattaatatataatcaatgatcaaataatatatatctaataaattaattatttaataaatcaatacataatttgagaagggaaagaagaaaagcttgaagatgaataggaggaggatgggttgataaaaaaattataagaacaaaaggtattggcatatatatgaacagcctcaacttttacatgggtacctatttttttttttttttcgtttaagttacgagaaggacattctcggttggtaaaagaatttccatcccaatatagtttccacaggatttatacagcaggagagatatggtaaaaaaaataataataataataaaaaaaaagctccatgcaattttttctaatgcaccaatcaggagatttttggccatgaacttcgtctttcccttgctccaacatggaatgagaatgtttgtgcagtttatcgggtgcattcatgttgtgttggtcaaaccatgacgtgtcacaccagtgacattaccgtcattgcggacacgcgcaaatccgcacgaagataaaacgtgcagcgctgctgttccatgactcacggccgtgaagttacaaggaaattatgtactttgtttctttgtgccttattctacctgtcgccaaagcgctcgggttgtaccgttcgcgcgagagggtgaccccttttttgtcgcgcaccaacaacttgattgtgctttgcacatagatttcaaagcatcctaatttttcttccagctgccggcaaaactctcaaagcgaacgtagcccaatccaacgacatatatgacatccagggaaatcatttttttgcattaaagatgctccccaaacccatctccatttatgctaccagcttgacgttggacgttaacgtcagccatgcgaccttcttttgatttttttttttcttttgttttcctttaaggctgcatatgatacaagcataaagaaaatgagaatataaaatactatgcgggatatttatgctaaaatctatttggttattaaattttttgaaataagttgaaaattaataatttcattgtaatgattgctgctgatttttgatttggatcaatttgctacagtgaaatgacgatcagcaaggagatggttactggacctacaaaataagtttctgatcagattgcctccgatagaaatccttcgatactcaaatcaagaattgactaaatagataggaagaaatgcaattagagaagaaaaattgcatatctaagaatcctcgatttatctctatttaaaaatcgagatgaaaatcataaaaaaaaaaattcgaggcctggacatgtcatcccgagatttccaacataattacctgagattagatggttgtgattgctttatctggcatgtgctaactgctcttagtggttgcgtgacttgaacgaagcatgcaggagtttcctattaaacttttcaaatatgacgatcaaaataggagttggagggagcgtgaatcgatggcttgctacacgaattattggagatagagatcggcagcagatatatggatcgggagtcgatgtggagatcggcatctggagcctagatcaatatccgatacatgaagattgtttgatgatgaggctcgatagccaatatgtagatcggcgactaatgtatgggtggtcgattgatctttagatcgatcgggatcagagtttgtcagtgtcttcgattcaatcatcaggaacgttccacccataatagtaatgttaatattattatgtcaataagatgttatattataataaatattattataatattattatattatattaataatattataatattagttttatagcaatacaataaatactaggtgcttatttagtacaatattataataatattgttatagcataatcatgtatattattaataattattatagaataccatgttatataagatattataataaatataatgtagttataatgtaatagtaattataatagtgtaatattttattgtagcattggagtaattatgatatttttgttagtagtagtatacatattatattgattgtcatcctataaaattaatttcggatgtacaatctaaaagagcgcataaaggataagcctgttttgagatggatatatatagaaaatggcgtagccgacactagaaaaatggatatacgatagtcagactaagcatagcatattctaattaaatcagtgctcattttgtcatcgggaaaaaaaaattatctacgctcattttataaataatgtttggtcagcataacgtacgctctagtgtgcctaaaatctttgtcccttaaacgataaaacattagagaagaacaagagaacaaaaaaagaaaaaaaaaatagcatccccaatcaaagaattaacataaaagatacttttcgctctaatctttctgaaaacaattaattgctcagcgctggatttcttccctttctctcacgcacagagctcacagtctttaatctgttttattcaatcaaaatgtatttaatggtctgctcgtatgtaagagtggtgctggtgagtaggaatccacttactttaacttcctttccatccctttgcacttccggtcagacatcaagtcagtcagcaatgttatccatgaaagtggtgtggcaaaggccatctcactttcaacagagggaaagcaggtcaaggtctcctgcggtgcaaaagcctaacttttgcacggcaggatgcttttccgttctaacgaccatcgcatcatttgaacgtccacaaaaggcggcctaagacggttggtatggcgaccatctatccagagcagcacatcgtttacggtgccaaaaaacgtgcggcaaacgattcgaactcaaatttgactcacccaccactggctgtcccccactttctcttgcatccgtttccgtttaggagctaaattcctatttgccctcccatccggccctctatatatatccaccgattccatccttcccttcagctctaacccaacagtagtcatggagaatgcgaaggtctatgcggtcgcttttctcattaggtttatatatgtggtcatgcagattttcaccaaggctgccttgaatggaggcatgaacacatacgtttatgtgttctatagacagctgattggcactgtcttcttggcaccaattgcttttgtgcttgagaggtactagttgctctatttttgcgggattttgaactttcattaattattttcatgtcgtcgttaacatattctgttatttaggaagagagctccaccgctgtcatttaaggtctgcttcaagattttcctgcttgcatttgtggggtaagttgtttttgaatcaaattccatgtttaagaaaaaaaaagctattttcttttaaataccgatgctttttttttttgttttaaaagataatggagactaaagggctgaaagcgacattagtctccagcaactttattccattgaaaaagatatatacaaccaaagtttaaaacagaatttacaacgagaggggaggcggaggaaggcctaaaaagaagtttcagctagatatatttgcgtgcttagttgcatgagcttgtcactcgagtggggagcgacagggtggttggcatagggtgcacgacattgatacattaataattatgactatattttttaaataaatataaatataaatatggatattaaattgatatcaaaattgggtattaaatatatttatatttattttaaattgaaaagtacttattttctctcaaggctagtgctatccaattatctacaagatgagtaaattccacatatggaaaaggaggtggatggattgtcatcttgcattgcttatgaagcttagcaacattcctttttctaaatcttgggaatcggagatatttctccaaatgtttgacattggtaatccttgtagacagtctcaacaacaacacgtgaaaaaaaaaaaaaaagagaatagtaaagtaaaaactgtttcaggcagtacacccattgttattttagacaaagaaggaagtactatatgctcttctttataatcatactgatgatatgtatatacatcgcaacattatatgacaattagttctttttattaatctcattttcttatatttccattaaaatttcactcagcatatctaccatagtccataattacttattcctatgagtttacccttcatactttgagtataatattttataggatttttaatgcttttctgaccacttttttttttgggatgtttaggtttgttatattcttagacacatatgctgttggtcttgattatacaacaaccacatcagcagctgcaatgataaattccattcccgtggttaccttcgttttggctgttctattgaggtatggctcgatcacattttttaaaagtcctatcttttcttttcttttcttttgtgttgaattggtatgtagaactatacaagaatgtagacatccaatggtgtcggtaggaacatcagacaaatcccatgaaacggaatcagtatgttggtcataacttatcttctctgtaccataaattcagcactctttttttttttcaaaaaaaaagacaactcatcttaaaaaaataaaaaaatcagtgtgattaagctcaccaatttataattgggctaccttgcctgtcctactgtctatttctcactgaattgcacagagtccactggctagacgaatcccaccaagtgagagagactgggttccaaacttggagcctttcttctccaaagcattttgatccaggaattttcaaattataacccttccctccctttttctttattttttaatttattgagggaaagggagggaggcatatccatataataattgcttttatcctaatttttggagatgttccatcagaagatttggatctggaacctttggttgttaggcactatataaaaatgagacaactccaatttaaatgtgctttctaatataatttttttggggacaatcttttcagtataatttacatgtgcccagcagcccatatagtatgcccttttttccaaaaaaaagcgcttgctgatctttcttgaaagaaatatatgttattattagatcttaatcaggcgttatcattgtttcctgacaggatagaaagcattaaggtaaaaaggcttcatggcgttgccaaagttcttggactgatactctgcctagctggtatcctgacaatggccttctacaagggaccccagttgaaatccttcaaccatcatcacctccttggtcatggaacgagtcaaagcgatcaaggtcactccaagtgggccctggggatcctccttatgaccatttctactatagcattgtctctgtggatagtcctgcaggtatgcttctaagctctaggcaccagatttcccagttatccaaatcaaaggtcctgcattttatcatgccatactataatttggttctatcttctgatctcaagacaaaatgattttaatttccactagggatatgtgttgaaggagtaccctgtcaagctttcattcaccactcttcagtgtctatttagcaccattcagtcattcttcatagctctagcatttgagagggacttttctaagtggaagttgggcttcgacatgaatctcctctcagtggcttatggggtaagtatttttcttttcatttctttcaagatattttttcgtgcgccatctttgttccatcagagcccatcttttctcacgaaatcatagcgtagaattgccaaaccttcctcactgagccctcctaaagctttcaaataataaaattagtaagaataaataaatatagtgaaaagaagaatatctaaatggagaattgatagagccagcttgcaccccttcattagaaatattgcctttatatgcgaacacttgattggaggtcaaatggagagttgagtaagaagacttaaattttctgcaacatagcttgtttataatgtattatatcaatttgctgttcatgctttagtgaggaaaaaaaaaaatctgaactacctttttggtgacaaaaataataattgaccacctaagcatgcgttgatatatcccttatcttatttgatcgagtgttgcatgacagggtatcatggccactggagtcacattctatttgcagtcatggaccattgagaagaggggcccagttttcttggctatgaccacaccattaactctggttatccaaatcatatgctcctattttcttcttggagaagtagttaatttgggaaggtgtgcttcagcgcttcatcaattctgctttacatattatgctattatgcttgaaaacgattttttttttcttgattatcatagcttgaaagggaagtttacaattgtaatttgtcattgcagcattgtaagtggagttatcatgattggaggtctttatggtgttctctggggaaagaaaagagaagagaaggatagcaaaatacaaataagggagaatgaacaagtttgcttggaggagaaagaaacagcaacaccagcaccaagaatagaagtctaaacaaatttactaaatatatacccgcgtcaagatgattttttttgttttttgattgaaagagaggaagcaaaaagcttcaccctagatttattgctggacatttcactactagaaattatgtactgttgattgatgtaactaccaaaagtcaaaaaaaaaaaaaaaaatagttatactacaaagatcttgatggttgtgaattccaatttccatgagaaaactcgttaagtaattagtttctcagcagtttttgactaacccatttaagccacgggctggcttagggttgagcatattcgagaatttttccaaccaagatatcgacaaattttgtcctgacagtcacgtgccgaaggtaggtggagcagatcggcggcgaagaccatgggctacttggtattcactcgtaccggactattcaatcgttaccccttacaatcggaacaattacatcaccgccatcaccccgaaaggcgcaaaagttgcacgcgtcatcgtcctttttctttccaaatgacagtactttcctctcatctggattttgcgatgatgtaagcagttggcacaagcaaaatcaggatcgtttattttatgatgaacagtagcaaaaaattaagcagaaatctctaaaaaaattttaggaagtaccgcagcaaaacccaaaatggtttatttggacagcatctgtggactttatttatacacggacgcaaacgtcaattccttctcccagacaaagccttaaaacatcctttcttatatttgttgacgcattttaaacatcctttattaaattgcaacccttctcgtaagcatcctgttagtctgaatgcccttcccgtcagtcaaccttccatcccctttcattggttttattaggccagtcgtgatgatgccatgatcaacgctgggtcaccacatgtgaattatcaagccattgtcaaaagctgtcgtaggaggcaattatgataatattttgctagtcattttcaaatgacaatatcgttggaagattgctttcttatcccattcttaaaagataaccataattgaaacaaattagattacggcaaataccttcctatcacacccatgaatgtcttcttatattattattattcgattctatatcgtttatgattttccatagttgttgtaactttccattatatcattgggatctggttctttgataactttatataaacacaacattaaaaagaatatgacgagagattacaggtgaagcaactcctcccacagtttttttttttttttttcctcattattcccgtgaaagtttgctttgcagtgatttaacaagccaacgagatcatgatgaaatgtaatcgaaggtgcttcaagaagtgtggccttgtgacgtccatcgtcattgtactcctcattgtgactcttgtgatcttatacttcaccatgttcaaaccaaaggatccagaagtcgagacgacgctggtaaatatccgaaacatagaatttggactcttccccactccgacactgaacctatcgctagctttagatatcttcatcaataaccggaactatgcagccttcaagaacgataacacgacgactaatatctactaccgaggggttttggttgggctgtcaccaatcgaggcaggcaccgtccgtccccgtgggacgaagaatataagctgcgtggcaaagattcaggtcgagaagatcatctccaatccctatttcttgccagatattgcttctggaccattaaatttgacgtcctcgaccaacatggacgggaaagcgatggttctcaagatctttaagttgcgtgcgtcaattcatgttgcatgtaacataagcgttttcgttttctcgggaaacagcagctctatctgcgaatcaaaaattagaatgtgattattttgttttcttcatttttattggaatgacaatctaatatttagtacagctcttcttcacgaagatccttgcgttcttttcacgccaaatttcccaacaaagcacctctattaattgaaatatcaaactttttttgccactctcttaatcgaaatatcaaacttcttcctcatccaatctctacgtccaaattccatgcaagcttgagggccatggccatcccctaatgttccaatggattttgagcgccgcccaaaagaagcaaacaaaagggcatttaattagaaggtgcgggatagattctgaatttgctccacaaaaaacacatcccgtacaaacttgccaaccttcttttgccaaaacatttttcgctttttcttgaatagcaaccttccaaagaactttattgcacggacaaatctgccaaccattattgatgaaaccataaaaggaattgaccaagtgagcttccatgaagggacatcagcaattccgaagggcctaacattggccaaacaactttggagaattccaattgtcttgtctggagcaaagtcaaaggtcctctaatggtgtaccatctccaagccaaaggatcttcaagttgaggtgaagccagctgatatccagaacttagatttgggatcctccttaagatcttcaggatacatgggtcaattcatgtatcatgtgatataagcatttttcttcagaccagaactggcaaatctaattgcagatcaaacattaaaatttgatattcttttttcctttttctttttgaaactacaacaaaaatgaagtcatgtttcgataaaaaagatcagcagtaacttgcttgaatttatttgatccttttgatgtgaacttagtattagtgttgatcagttgaaatgaagtagattacacagtcttttgttgcacctttttctaaccaagtggccctattttttttccccttttgcccttttttcctttctgaggatatcagagcaacacatcaagcatgtcgctgtgaagaaaaagtccctccctccaagggcaatggacaaaaatatctgaattacaggttcaaatcctggataatttacctgagtcccaacaagggagaatatggatccatctcacctgatccagaggattttgtaaatggactctaataggatctataactgatccattacttacttaggtcaaggaacccaaatatcagagaccttaaacaactggaaacaagtcatattgtggaccacggcttgtgaaaattttgcagatgtcacgaagtctgaaaaatttgatacattcagtcccaccaagaggacattcaagcatgattaatagtttggtgatttctcgcgtcgtagctacaacagtcagatgaaatagagctcaactttgaaactaggtctgaaagggagaagaagacagcttgagaaaggtgatttttgagggcaaaagtgtatcaataaaagaatgatcattaagggctcatcaagggcatgaaatcaggttaagaaaatttgaaggtagtagatgtgctggggttgggaagaggagatgttggagtagaaacttggcttctacgtctgaccatttttgcagataatctgctggtccaacgtagaatagatggattgatagttgcgacagcaagaaattttgcttcgaagggaggtgaagtttcctggagttccttttctagcagtaggtcagagaaaaatactagtgcgacattttcctcgtgaaagcacaattgctcacggaacttcttttgaggaggatgctcactgaaatttcgcatcttcaaaaaggcggaccaaagtactgtaaaaagctaattgagattagaaagtttgtgagtttgaaaagtttaagcacatcaaagtcagcataaatctcgggcatcgttaccttttcaaaattgttaggaacgagccaaaaatgtctttctcagcccacgctgtacctctagggctcgatggaagtgcgctttatatataaattcatgaaaaataatagctaattcagattaccggggtgccgagctggcctgttcttttgagttttgcatgccaagtctcaatctaatagtagcaatttatggccagattcatcaatctaatctacaaacaatccattttaagtaattcgagtcttgatattaattattttggattataaatagatcgatccgtctttgtttattaaatgagttgggttcaagttaggacttttgatccatttaacatgttttgatctgtctaataattagattagattataatccgatctatttaatctattttaaatttatcttctgacatgtttaatctaatctgtttaatttatttaatttatttgaagataggttgtataggacggatcaaattatctattttataaacagatcatattcaaatctaaatttttgacttattcaataaataagttagatttgggttaataaatttttgatccgaccagcttccaactcaatatgtatctaaccctatctgattgccacccctccctcaatctgagtatttttattttttctaaaaaaataatcataagaccttccaacacattttagaaaagaggctatttcataccaccagggccttagcgcagcacttgtttctattttcaacgtgtgttcattcatttcttgccgaatattgctttaaggtccataaatttgatgttaaaagccaaatgaagggggacatgatctctaagttacacatgtcaactcataaggtatgcgatgtttttgttataacgagaaatagcagctctatctgcaattcaaaaattagaatttgattattgtattcttcatatttactgaaattatattgtcattagcaatagttacttggtcagtttggatatatatatatatctgtgatttataaccttatattaaacttcatgataggatgcatgttttgatcccacaggattatgcataaaatcctattaggagaaaaatctcatgtagctaatcttaactcgtgtttaggtaataaattaaaattttcttcccctcgcttctttctcctctctcctcttcttttactaaaataataaacttatcattatcaaaatcatattaatcattataattatataaaacaaagctaacatatctctatgtaggaagttgctgtggtgcttcttaattattttcaatggaaatgataggaaacatcctaaccattcattacatagggataattaaaaaacttttattttagcaggtcaccaaactagttgatcttgcaccaccccctctctttgccggcagtctcacctccatctcgctgcccctccaatcggacatgccatgatccgtcgcctccacaacctctcttccatgtttctcgatcgacaatagaaaaacaccgactccatcgtcaaagaaaaaattaggagttggaggagaaaagaattttgaacatgccaataagattttcaaaattttgtgcattagccattgcctgtgtattagccctaattgttgaaaaaattatgcatactagtcttgatcgtgaccgaaattatagaaaatggctgatagaaaatctcaagtattatttcttaattagatggctagttagttttcaatgaaaatgatgattctactcttttaaagcacctagcaaatatttttatgtatttttataattttaaatttgttcatattttagatggatttgaaatttatatcttggatatctactactcaaatttgattatatatattttataattttttattgaaaaataaaaggtatgaatatttgacttccaaaaatttggataatctactactgccctaaccaataagccataattcacatctatttttgaaataattgatgatatatttgtagggtttatactattatatacaaatacccaacacagaaccctataatttcctaagcttccctactcggccgctctaagcagcctgctcgattgagacccctgaggacgtaaaaaggcaaatggggaaaacatatgaaaaatcatgtaaggccttttcccacatagattgatcattatttttttttcttttcacttagttttctttccatttcattctcttttttggagatttgtgttgaaagagaggattggagggagatcgggggtttcttaggtttcggttgggcttttctcttaggttctggcaaaggcgacgaggggacgaatgggcaagggggcggtgttggggagggcgaggaggaggcagaggagggcgatgaaggagaagggcaattggagaggggtaggagatggaagaggggtagggaggcagtaggggagggggcacgggcgaagaggcatcgaaaggggggagggggaggcccaacaatcgtaggagatgaaagaacctccgtagattttttttccccatatggatagccacctcctaccattttttaatcccatgattcagccagacaatcagtggatgggaaaaaaaaatgttggtgttattcattgtccgttgatcccttaaaatttgggccaattctattgtatccaaatagatccttgatcaagcacataacttttaagttgcatttggtagccgataatctatccagattgctagcaatttaaaagagtcccaccagattatcaagtttgatatactttttggattggtaattcagattatcagataatccagattatctcctatgacgtaatgtgaattaccaaagagaaaggtggctatccagaatatcatgtatttgataatcttataataattttttggataaaattatcttcaaaaatctggacgatcttcttcctcatgatgggtagcggaaaaaggagagccaaaatcgacaccctccttcataagattcggctagcagcggctccaaaatcgacaaatcaacgggccactgcagtctcccaaccatcggccattgataaccatcaagaagtaagaggaaaatgccgatcaagataggacccgatgacccctccccctttttttcgtttgtttgttaatcgagccaccgatgagccgcatcgggcaccgtcgactgcccagatgttgccatcagagttgccgctgcctctccgatcagtggcctgcagtcattacacagaggaggacacagtgtggaggagccgatggtctctctctcctctttttttatctgatatgaggaagaaaaagatcgggctcagtggagatcaagcgacatcagtcactactagtgacgtcatgtcgaatggctgtgggggggtggggtgtaggggaccgacggtgtgagtgagggcggcggtgcaggtgggtgaaggcggtgatggaggtggctatggagggcacgggttgcaggtttgccgggggatcaggggatggtacagaaggtggtgcaaacgatcgaggggtcgagggtgatgctggagatgcgattgtcgagggatcggaggtggagttgtcgagggtgggggggcattgtggcatgcgagggaaggagaaggatgaaaaaaataaaaataaaaaataatataatacatgatatataatatataatatataatatataatatattataatatatttttattcttttattctgaaaaattaaaaattaggtgcatggagtataatttttaataaatttgatttaagaatattttaaaattttgatgttatattactagtgatctgattatcatatccaatatataaatcaatatttttaataattttactacaacattacctatatgtaccaaatataataatcaacattactgataatctattcagattgcaggtaatctagattattaagtaatccagattataactgtcttacaatacaccaaacgcaaccatatatctacaagttggaatcataattataatattatattataatttaatgaaagagagagagaaaaaaataaataaagaaaagaataagaaaaggaaagaaaaaaagaaagagaaagaaaaataaaagaaagaagaaagaaaagcataatcgattgatccttcaggatttgggccaattttatcttttccaaatggattcttgataaaataaaaaaaagtatttaaattttatttctataatgataattattacattataattcaatgaagaaaaaaaaggaaagaaataaagaagaaaaaaaagaggggaaagaaaaataaagtaaagaagaaaggaaagtatggtcgattaatctttcagaatttgggtcaattttaactttttcaaatagatctttgataaattaaaaaaatacttaaattctattcctgtcatttgaaatcataattattatattaaattcaataaagggaaaaaaggaaaaataaagaaaaaaagaagaaaaggaaagaaaaaggaaagaggaaggaaaataaagcaaagaagaaaggaaagcaagatggatcgatccttcagaatttgggctagttctatttttttcaaatagatcattgataaaataaaaaaaagtacttagattttgtttttactagttagaattgtaattactatattataatttaataaagagaaaaatgataagaaataaataaagaaaaaaagatgaaaagaaaagaaaaaaaaggggaagaaaaatatagtaaagaaaaaaaggaaagcatggtcgattgatccttcaggatttggaccaattctatcttttccaaacaaatccttgataaaataaaaaaagcacttaaattttatttctactagatcgaatcgtaattattatattataattcaatgaagagaaaagagtaaagaaataaataaagaaaagaagaagaaaaggaaagaaaaaagaaaggagaagaaaaataaaataaagaaaaaagaaaagcatggtcaattgatccttcaagatttagactaattctatcatttccaaataaatctttgataaaatgaaaaaaagcatttaaatgttgtttctctttattggaatcataattattatatattataattcaatgaagaaaaaatgggaaagaaaatataaagaaaagaagaagaaaaggaaagaaaaaaaacaaaggagaaaaaacataaagtcaacaagaaaggaaagcatggttgattgatccttcaagatttgggcctattctatcttttccagatagatccttgatataataaaaaaatacttaaattttatttctgctagctagagtcataattattatattataattcaataaagagaaaaagggtaagaaataaataaagaaaagaagaagacaagaaaaaaaagggaagaaaaataaagtaaagaagaaaggaaagcatggtcggatttgggtttattctattttttctaaatagatctctgataaaatttaataaaaaactatacttaaattttattcttactagttggaatcataattattatattataatttaatgaagaaaaaaaaaaggatgagagataactaaagaaaagaagaagaaaaagaaagaaaaaaagaaaaagagagaaaaataaagtaaagaaaggaaagcatggccaattaatcattcaggatttgggccaattttattttttccaaatagatccttgataaaataaaaaagtacttaaattttgtttttgctatttggattcataattattatattataatttagtaaagaaaaaaaaataaataatgaaaagaagaagaaaatgaaagaaaaaaaagaaaagagaagaaaaaaaagtaaaagaagaaagaaagcatggtcaattgatcattcaggatttgatctaattctattttttccaaatggatccttaataaaattttaaaaaaaaagcacttaaattttgttactgctagctggaattgtaattattatattataactcaataaagggaaaaagggtaagaaacgaataaagaaaagaagaagaaagggaaagaaaaaaagaacaaaaaagaagaaaaataaagttaagaagaaagagaagcacggttgattgatcctttaggattttggcccattctatctttcccaaacataattttaatataattaaaaaaaataaataaattttatttctactaggtagaatcataattcttatattataatttaataaatggaaaaaagatagcagcactaaacaagtccaattttaaagtgagttctagtgagagaaagttcagaatggagaaaaagaaggcgagtgataaaggatcaatagtgaaccctatttctatgagaaaagagttcgaaaagggggaagagaggccagatatgaaaacctctggcctctctgatgagttttcaacctttgtggaggagggctcaactagcggtgtcaagcttgatcagcgaggggctttcaagcccaggggttccatttcctctggcaaggaggtggaaggcttttacgggactactccatcatctggaaagaagactttgaaagaaacaggtgagcaatccaacccttcaatgattttctcctctgatacatcttctctggagcactcaagacctggtaggaaggtggttagaaacggtgctgatgcggttcccaaggaaggggcttttatgggggaagctccatcgacctcaaatccgaagcttaaaggggtccatggatctcctcccaggaactcagtctcgaagcaaggaaatggatctcttgaggctccgaaatcttggtcacaagcgcaatgcaaatttcagtgggtggcatcctcagcatcggcagaggagatagctattatggagaagcgattttcccaggtggtggcttttgcagacgaggagatcgatctattctgtgcctgatggaaggctgctttgattgataagtttatggatagagggtttctattgattttgtctaaaaaaagatgagagtcatgatggaatgtagaagaaaaatttcaaatgtactctctctcagatggagtcttactatttgatcttccatcagaggatatccaaggctatatcctagcaaaaggcccttggtccttggctggtcaattacttgcattggagagctggagaccaaatttcaatcccagtcggaacgatgttcaccaactgagggtctggattcagctatcaaacctccctattgaattatgggatagggagaagatattttaaattgtttctatagcgggctctcctttgtcccttgatgattggatggaatcatctattaggaagaaatttgcccaagtctgtgttgttggatgccacaaaggccgtttgcccagaaaccaggattagggtgaagaataatctcttatcacagtaattcagttatgaagagttgtcggacttgtgctactcctgtgggctcctgggaagaacttgggaatcatgtagctatgcgaagattcatgagccctaccaagtttatgattcttggattcgtgtggccaggatactggtcaattgggaagaatccaaagaggctatcaaaaattctaatactggagctgctggtggatagcctactgaagcttggtctactcctaagaagacttttaaaaagtttcctcctaaatcctcccctaacgttcaggaaaaagtccaaattagtggaattggatcctgatttgccctattgcaatctgatgttcctgatgagccttcggaaccccaaagcatggacattgtagtcgcctcacctatttcatctgctttgatggttctgaaagacaaacataaaagatttcctactaaagtgccacctgccaaccgatcacttgacttcatctcttccccaacttcaaaagttatagtcctcgagaagtcatatgctcgagaggaggagagtcggtagcaattatccgatgctctagttccataattgaggggcacttataagaaactatggagaccggtgggtactgctagcatgcttggagccaatcaacacactaagacaatgcctatcacttcatcaacaactcctaacccaagcttagaccatctccaatgtaaactttcccttgatgtttcttcatgcttcaatcaacttcaatttactttacaaaacatctccggaggtagtttgttcgtggtggattcttttgggaataaatcatgtgtgaccgaaggggcttcgagagcactctttcactctaccctatgaattgttgggaaatatgtcctaaagccaatcatctaagtggtagatgattggaattaatatatgaattatctaataataatnnnnnnnnnnnnnnnnnnnntcaaagagatgaattatatagtaaccatggatcagggttcttagaatgttgctttgcatacattcgatctatctggacgtcgaaaatcattgctagatggttacttcgattggtacagaaattaatttctatgctatcgacttaagttcaaacctataggatcacacacataagagattataatttaatcaaatggttaatcgatgattgagaatcattctaaggttaaacaatcaatgtgattgatatttgacctaatgcaagtgttgcaggaggatcaattagcaattgaattgctaattggcttaatctgattgagcaattgggctaagatcaagtctaaatgaatttgattcaattagaattagtttgaatttaattagattaagtctaattgatttattggataagccagttgcaagagagaataagttcctgttcgactaggacttgtatgcacctaatttttaattaagttaggatttaaatcataattaaatatgatttaatctgatttaattagacttctagttggattgagatcatccttaattagattgtaattaatttggattggattcaaagagtttgacctagtctacatgagaatcctagttagactaggattctatttttctcccttgcgccacctaagaaagtccacgcccatatatttattttcagatattttttatgtgatattcacatctaagaaaagtaatctcacaccatttattttagagatttgaatcagatttgatttggttcattatggaaagtgattgggtttattatggaaagtggtttggatttattttcttttgaaaagtctctcttcacaagaactcctctctcctctcttgcgccaattttctccatacctacattctctttatgatgcctcttttgtgcatggttttctactctccatgcataaaataagagaaggggcgtccaagagttggatgccccatagttttcttgtttgactaagtcttttgacctagtctaccttatatagtggtgcctcctatatgatgattttagggagtcaaaaatctatgattttttcataaaaaaagcagagaagaaagaggatggcatgggtgttttgaggcatcaatttttttgaaggagagtcttctatcaagacatcaaaagttgatgtcctgtagagacaaaaggtaagagagaagattgttttctcttattatttttctttcagtttattttctctttatttttgtatttttatgtgataaaaatctgagagaaaaagagggatggcatggtggatctatgctccaatgagttggggcatggtgatctgatattggacatgatctgatcatatcttgatgagagaagaagaagaaaagaaggtcttcttttaagatttcttttagaactcttcttctccatcaatcatgagatttttctatgaaaaaaattagataacataagatctgaaagtttgagaaacatctagagaagaagatctcctcatgtcctagcatagagatgttctcaggacatcaattgttgatgtcctaaaagagaagaactgtcttctcttaggaccttttctattatatattatttctgattttaggaaggtcaaagggtttgacttctccctcattccttctcatattctttatctcttggaatgtccaagagatccgaagaatatttatagattaaccatctagagggatctgcaagaagctagcacttcgagcggatctttgttcgacgaatcttcgattttgttgcagcctcgtgtggattacttgtagaggctggatgcgtgtgcggcttcaaaagcaataaaaaaaaatcaactgtggagttttcgtacccacgcgaaggtaagagatatgatctcttctcttnnnnnnnnnnnnnnnnnnnnacttataaatgcaatatgacatgttataggtcctaattgtaggatttagtaacctgattacatgtatttgtatattaaattatttaatttacatattccgctgcgttacatttcaaaaatattttaaaatttatgcatgaaaccctgcacttttttcatcagatcctcacatggaactgcaggggtgctgctaagtgcccatttattacctactctaaattgttgattggccagtataggcctgatatctgttattttttggagacacatctctctgaccatgggaaaaagagggtgcaaaggctgttgggacctgtctggaatctccacatgattcttgctataggactttttggcagtattcttattgtttggtacaaaagggttggtaatgttaattttactcatactaactgacaagttgcattcggtattatctctgttgctcagtattctccatgggtcctaggtgttgtgtatgctagtacttgtagaaaggaaagatagattctgttgcaataaattgaagcgatcctctctatgggcctgcccttgatgctagctgataattttaattgtatagtcaatcctgaagacaaaaaagacaggaagccatttcatgtggatagggatattagggagtttagagattttttgcgtagatctagtcttattgatttgggatataaaggccctagctttacctgatgtaataatcatcttgggttggctagagtctaggagaaaattgatcattcctttgcatctcactcatgaggagaatgttttgaagatattactgttttccatcttgtcaggttcgcttcagatcattatcctcttttgatatctctaactagtgggattgttcgtaaccctccgccctttcattttgaaaagttttgactttaatgctagggatttcgtgaagtggttacgaaggcttagcattgtattggaaactactctcctggtgttagacttgtgatgttgttgtctagcactaggaaggctatcatgagatggaagtttcaaatagggaacactttttctaaggggcagcaattatatgatcaaatttattaacttcaattgttagaatctcaaagtcaaggtctctctattgatcaacactttcagcttctatctcttctccaaacctataatcagaatcttcatcttcaaaaaattttatggaaataaaatactagaatttcttggctgaaggaagatgatgctaattcatcctttttccatcactctataattctcagaaggaggggtaaccagatttcaatgcttcataatgcctaggatcaggaggtgcatgacgttcatgaaatcattgatctgctcctcacatactttcatgatcgatggacagcccaacaagatttagaggaccttgacatcccaattctttcatttgtcatctcagaagccctaaatgcccaattaactaaaatgatcaccacggatgaattggaggaagttgtgtgaagtttaaaaggtgataaggcccctggattggatggtttttctactatattttatcatcattttgaggacattattaaaggagatgtttttcaagccattcattatttctttatgaaggccatgacgtcggatgcttggaaaaaaacctagatcactttgctgcccaagaagtcaagccctcttcaagtctttgatttcaggccgatcaatttatgtaataccattacaagatggctgctaaagttttggctaatagaatcaaacctctgctttctatcatcatatcaccctagcaagattccttcatccaaggtcagaatattactaataatattcttttagctcaagaaatattgcattctcttaagaaagtccctccttttaaagggctggctttgatcaagcttgacatggaaaaggctttgcattggccctttctctttcatatcttatctcaattggggttttattctcaatttatagcatggatcaagggctgcattctttcactataatttgctattctggttaatggatccccatctcatttatttcatatttctcgtggtttgaggtagggttgtccattgtctccttatttgtttatcttttgtttcgagattctatccaaattcttgcattatgtcgtagatgtcaaccgtttaaaagcttacaaggttccaaggggaggacctactatctttcatctcttctttgctgatgactgcttgttagtgtctaaggcaaatattcgggatgttggttgcatgaaggctattattgatgcttattgctctatctctaatcaagccattaatctttccaagtcccaaattatgattagcccaacagttcctaggagaatcaaaagacatattcatcggcttcttgctatgaataaggttgctggtgtgtggaattacctgggggttcccttgtttggtaggcctttaagatcaggagccttttttgatttacatgacaaggtaatgtggaggatttttagttcgtaatggaaaactctttctttggccgaaagagccactttcctcaattctatcctaacatctattcctccttacatcttatcttgcattcatgttctggtgggtgtcatcaggaaatttgaaagagaatacaaagcttttctttggggccatgctattgatcataaggggcttcacttaattgcttaggagaatgtttgctccccaaagaaccaagggggatttggccttacatcccttcatgaccgtagaaaagtctttttatgtaagcaggtggctaatctcattcttcatcctaactctctatgggctaaggtgatcactgctaaatataatttcaaccaatcttggtctttatattctcctccccatcactgttccaagatatggaggaaaattgcggctaaaggtttttctgttcaatttcaattcctttggctcataggcaataggcaatctgttaatgtatttcacgatctatggatttctaatgtgccattggcactttggcgtatggcctccaccattaagttcgatgcaatgcttgatagccatcattagaagatgaacggttatcaaataggatgctcttatatatcatgcatgcatgatgcatcttgtttgatggttgcttcctttcctattcttctagaacacgaattctctatactgtacgatttcactataaaatcttttgatatcaattttcctattaatgatattcacctcagtgctcttatttctgctgatgggtgtgggatttggatttgctacatgatatctttccaacttaaaagatgagcctcattactcgcatccctattgcaattggcaactggtctgatcaattggtctggtatccatctagaagcactcatgtagccctcaaggatatccaaccacttattaacccacagcagtcttctaacatgtctttgtcaattgactggatttggaaattgaatgttccccctagagttaaatttttttgatggaaactactacgagacaggctgcctttcaagttttttctgcttaatagagggatccttcaagcatctcagagccattgtgatgtttgtggtaatgttcctaaggatgttaaccacattctcttccaatgccctgtgactgtgggttgctggcaaattcttaatcacatcattcacttgtctgtgcctaattctttgccaggtttggtcgatttgctgtcaacctttggggtagagaaaggcatctctggttgcaattgtggcctgacaactttggactgcttgcaatgaaagggtctttcagcagacctacctttcttctctcagtattattcaacaagctcatctttgtatccttcctagtgatattgcaactcatggcataaattttgggtgtcagttaaggcactggggtagtcatttatcattcccttacagtaattctcacacttcttctcattggctccctcctcccttggcactttgaaaatcaattttgatgctgcgtgccagttaaggcactggggtagtcatttaccatttccttacagtaattctcgcacttcttctcattggctccctcctccctttggcactttgaaaatcaattttgatgctgcaatgaaggaagaaaaagctacagtgggttttgtcatttgtgatgctcagggtgctttaatttatgctagtggaaaacttttctcctctactccgacctcttatgctgaacttatggcgcatgggtgcgtttatagactattgtgattcagttgcattctttgcatatttggttagaaggtgatgctttatttgttatctcctttatcaataatagtatcatgaacaggtgtttaggtcctcccatccttcaggacattatcagatggaaagctaactgcttaacctttttagcttcgcatacttatcggcacaacaactgtgctaccgattttgctgctaagcttgtttgcagggagacttcttttgcaatgggggtgacaccttaaaccaggctttccatcttattttgcaggctgatagctctcggatccctactctggatggtcagcagatactatctggggtgtttcctgtatagcctttaatcctgtttgccatctatttatctttttctcagtttgtttgtaccaggttgtagtgttgttaacttttattttaattactgttgtaggttgttgtgctgtctacttcagatgtagggctgtttcagtttctttgttttaggttgcttgtttcaagttgtagtttggtttgtatcaggtggtagaagttatgtactttggtttacctatctattgaaagctcaggctcctgtttctatcaaaaaagagaaaaaagatacgaaataaataaagaaaagaagaagaaaggaaagaaaaaaagaaaagagaaattaaataaagaagaaaggaaagtctggtcgattgatccttcaagatttgggacaattttattttttccaaatagattcttgataaaatttaagaaaaatgcacttagattttgtttttactagttggaatcatagttattatattataatttaatgaacgaaaaaagggtaagaaataaataaaggaaagaagaaaagaaaaggaaagaaagaaagaaagaggaagaaaaataaagtaaagaagaaagaaaagcgtggtcgattaatccttcaggatttggatcaattttgtttctgctagtcggattcataattactgtattataattcaatgaaggaaagaaagaaaaaataaataatgaaaagaagaggaaaaggaaaggaaaaaagaaaggggaagaaaaataaagtaaagaagaactaaaagcatggtcgattgatcatttaggctttaagctaattctatctttcttagacaatccttaataaaattcaaaaaatatttaaattttgtttttgctagttcaaatcataattattatattataagtcaataaaggggaaaagagaaaagaaataaataaagaaaaagaaaaagaaagaaagaaataaagaagggacgaaaaataaagtaaaaaagaaagaaaagcatgatctgtttatccttcaggatttggcttaatcctttcttttccaaacagatccttgatattaaaaaaaaacacttaaattttagttttgctagatggaaatgaaattattatattataatttaatgaaggagaaaaatggtaagaaataaataaagaaaggaaaaagaaaaggaaagaaaaaaagtaaagaaaaaaataaagtaaagaaaaaaggaaagcatgatcgattgatccttcaggatttgggccaattctatttttttcaaatagatcattgataaataaaaaaagcacttaaattttatttctgcgagttggaattgtgattattatattataattcgataaagggaaaagggtgagaaataaataaagaaaagaggagaaaagagaaagaaaaaaagaaaggggaggaaaataaggtaaagaagaaaaaaagtatggccaattgatcctttaggatttgggccaattctaatttttccaacactataaaaaattatttattagcaacggctaaatatcatcgctaattgttgaaaagctgttgttaatactaagaacgatggtaaaccattgccaatgaaccatcaaaaaaaatttgaatactaaagaccattattagcgacgacgagaaaaatagtcgctaataaagtattggcaataataattagcgatgatatgttcatcgcttataataattttaagttattttttaatttaaattaaaaaatatattagcgatcactataagccgtcattaataggcttcaaccattgctaatatttagcgacaaaattagccatcactaataaataattttttttaaaaaacttatagaaaatatatttactaaaatctaccataattaaattagcaatcaaaatatatttacaaacactataacaactaataattaactatcatcgtcataaataaaaattaatattacataaaaaatataaattatccaattgtacaagataatattgttcaaatatcaaaattaaatatattacatcaaaattaaaaaaatcaacgaagatccttctcctcatcctccttctatatgttgtctgcagcagtagatcgatgagaactggatgtctcagtatcccatagtgaagaaaaataaaacattattaataattttaaaactaaattaattaaaattataaaattaaagaattagtacgtcttaagcctaaatatttttggaaggctatagacaccttcaatatatccatcagatggttagattgaattttgacctctttggtaattcctttctcccgcttgaagcctgaaccgacacgaaggggtgtattttgttatattttttcaatttttaaataaattatttttatatattttatttgatattatgaagctatacacattttcgatccatccatcggatggttagattgaattttgaccctctggatactccttcctcctacttgaagcttgaaccaacatgaagggatatattttgatatactcctctaattcttgaatggattattctcacatatcctattcgatgatacaaatatatctatatcaccgagccatccatcggatgggtagattgacttttgaccccgagatccccttctcccaactcaagcataactatgtaaagcttctaaatataaaattttaaaataagtaaaaaaatttattaatactatttgacttacctactgtgatagctgtgacaatgagcttagctaattatatagatacggatctcagagaatctcaacaacaatctcgcgaacggcatcccaaaatatttgaggtcactaaaagaaagcctctgcatgacctcctcgacatatgcatcaccccacaatcagattgtcgagacttgagaggaggacatcgaagattagtgagctactagagggtcgaagctatatccgaaacctataatccggttcctactcaccccttcagtggtcctgagccatcctttaaggtcaaggagggactaagaggatggatcctcaccatgctgcactacgatgtattccgcataatctatctaaataatttaaaattttattagtgctattatacatatcaatatatataaaaatttaataaataatattttaaattattgtaatctgtttggacctagaatctaagtaattattaatcctcttaaattgatgtgtagtctcccataactgtcgctactctggtacatgatccaattgccatgtctacgataagtaaattataaaattaagtgaataaaaatatatatatatatatgatcaactaaatatgggattaatataagtttaaaatttttatcaatctatctgttataatatatgtgccaacggagtcgtcggtatgcttgatcggatcctgctaggctatctgattctgttggaccctctactctcgatcaaagtagttctcactgctccactagttacagagggcctcccatatatctctccacatctagtaatctatgaaagactttcagtttgatggtgactcgaaactagagaattctataggggactacctaaggttgtacagtccatctcagagctacatgtggccacctcttcgaagatccgatggccaacctactcatcctgaagagtctcaaatcgatagtactcttacaattagaagcaagcatatattaataaatagaatataaattttaaaatttaaattgaacatctttgacttatcaggaacatctttcaggctacatcatgagactccgatgaccaactatagaacttattcactggcctctgtatcaatcgtcggatgatcccgataactatacgggataccctaggcttcctaaatattctacaaaattaattttaaataaaatatattgattttaaaatgactaagatttttaacatattcttcgaagatctagtatttatgtatggctctgaacgtggatgagctatctatcctccgatcgtgttggaggtgccgtgagctagatggatcctctatcacagtgctgaggctgagagttggctgctgctccatgtgactgtggggtcaatggtgaccctacatcgttcgaactccttgtgactgtggggtcaatggtgaccctacatcgttcgaacctaaaagtagtaaaacagtataaaaaatattatattagatattagaggatcaaataatctaaaagaaaatttttaaagtattagagtttatcaaatggtgtggatgtcgcagaaccatatgagctgttgccatgagagctctctccttgagggctctatcctctggagctctcttcttgactggcacgactccatcctctaaaactagatatcatataatctatgaaaataagaataaataaatttatggattaattatataattatgataaataatgcaagaattaaaatgatacaagacaagtatgaaaagcaaataaagtgagcacaccacaaagataaagaaaactagtcattatgttatcctcttgcttggggtcgactccattgcatatcaatcatctccagcatgctaaagttgactcctttatccttaagattgactcttccctttagatgattgatatacttatcactactcatcgtctctttagatgtttggtatccttcaaattcttctttcaattcttcttcttcttccacttctttttctttttcctcttcttcttcttcttgaataagattgccctttaaaataaactcaatatgatctacctccttatgttgccaatcatatagaagaattcctaaaacatccaattttgcatttattaaaggctgatgaactccaaagtttcatcctcctgaaagcattctgataaacaaggctctttttcttcttcaagctcataatgaatggcttgagatttaattttacatataatctatcaatcttttcttcctctctcccttaatgaaaaaaaagtataatacagttgaatagcttattgaaccagcacaaaggggttgttgacatatgcttttgatttacatttgatttttataagcccatgttagaacagacatctcgtacacacaaggcttcgactgcagaacaactggatcatgtgacccatgcactctctactatcccacgtcgatgggtcgagttggagcattcatagaggcgacactctctactatcccagcagagcatccaagcaaatcccaccccatgggttcctaaatattgagcagcattgcaaatgggaaggattagaatgcatattccatgcacaaattaaattcaaacatcattaatttaagtaaacatcataaattttaattcaaatataaaaaattgaaaaagaaggaaaggaaatggtgtgtggtgatggctccatcaccgtcactgccatcatcgctaatactcatgaatgggaagaagaggagggaacgaaggacggcaagggtgtagggatggcagatctaacacaaggacagtggatctggtatggaggatggtagatttggtgcgggggatggtggggatggtggatccattgcgggggatgttagatatatatcctagaaattaatatggctgacacattgtaataaatctagagcataattttatacttaatatattgatttaatcaataaaaggacaagtttgattttcattcaagagtgatgtgtgtttgaatcattcataaaattaaaatattaaaaattagatatatgtataatatttttaaatttttttagtcatagtatcatcatgaggatggtgattgatctgaatagatcgatccacagatcatttttttagagtagatgagtctctgatctacagtagagagatattaaggatgagtgtgaatatttattagagaacaattagtactgaacatgatcatacaagagatcacttgaatttttactcaatcatcagtgatcatctcgatgctatagttatgtgaatggttatttgatttgcgatggtataattgctcgcagtgaagctgctgtagtttgattgacacataaatatgatctcattgatatcttgtaatggatattgatgacagttagtccactgtaggagtagagtatgcatttagatggaatctatcaattttaatagagaggagtagtcctataaaatttgagaggctaagttcgagagtttgtggccatagcagtacgattgatggaaaagagttttcatgagaatcataattaaacttaagctaatcgaatctatcgtatgactgatgatgagatttgatgatttatccattatatactatctcgtcgggactcacaatagagggattgaatcacatgtgaattatactttaaggttctattttgattcttcgagattgcgactacatactgcaaggtaacactggtggattatgagagctcactaggattattcaggatcgataatctttgatgagttagagtgaaaatatttcgatccattgaaaaaaatttcaatgatactgtgatacagatcatagtatatctcactatcagatagaattgaatctatgaggtcacacaataaaaagattagatctgaaataagtaattaagcttatgaaatctcaattgagtttagagaaactctattagattcaggataatcttgctagcatatgattgaatctaatttttttcttatacttgaattacttatttgataagattaatttgagttaattatttgctaataacctaaataaattagattcattaggctccaattattgagtgcttggggttttggatcatatgcattaaattttcaaacccgtaatcaaattttttgattgtttgcattggggaaccacttgatttgatcaagttggacatgcctacttgatagagggcgtatgggaccagcaaggggcatctcctaagccctatgtggcatgcgagaaagtgggtgaaaaggctccaataattggttccttatagatctcctaaagggggtcaaatatctaagattacaaggattcctaatgcaagtaggacttatattaaggagctatttggttttgaataggattcaaatcttttgtctatttaaagaaacattctttaagtctctaaatatcatatttttagtagccccacacctcctaagagctccccatgcctccctcttttctcccttttggttccaacacccaaacatattgggcatcctctatctccacgcccaaaaggaatttgggtgtccctcttggttgctggtttttagaccttagttgcttcataatcaagagaaagtgagcaagaaaagaagagaaaaaaaaagatcaagaaaaggatcaaagagttgatcgtgatccagactttgttcagattcgtagagtgatctttcttggagaagaaagatcaacactataaaggactattctagactgatcctgagtggatatccatagagattgatacttgtatgactaatgaagagccaatattcttttagatccagattcaaaaaaaaaattatgaaatagatatatgattcgatcatatatttaatttcagtataaaattcaatatatgtttaatttcagcatataaaatagattcatgtattttttattttatacatatataatttaaattaaaaaatattttaattttttattctactatattgtttagaaaaaattttttgaagcatacatatatgctcatatacaaaattccaacagttatatcagagtcacagattttatatgcataaaattaacatatatatatattttttaaatttaaaatctatttttttttgatatatgagatatatagatgattactttgaatctaaattttattttagatttaatttttagttcatatattcgatatgtgaagcatgcatagatctgaaatttattctagatcagtttctagttcgtatatatatgatatatagatacatatataaatctaaaaattatttagatctaatttatgattcatatatgatatatatgattgcatatttaggtctaaaaattaattttaatttgattcatattttatatatacgatatatgatatcatgttatgatctaaatttttgtttagatctgaattttatatacatatatgaaatatatgcttgtttgttaaatctgaagattggtttcatcatttaatacttatctttcatacaaagaatttaaatataaaatttaattttagaatctaaaatttatatttgtacaagaggattttggtcatgggtaaatcaaaaattaagtcatgtaattagattgcatctagagtttttgatttgaatataatagatataatttgattaaataattgatcaaatcgagtcaagtattgattaagattaaattaattaagttttaagatcgtataattattgttgattaaattgattaaaatctatatataaaattgattaatctaagaacctaattcagctcgatggcttgagcctgattcacttaagctaacttatttagactaattaatccattggtatctaaagcaagtaattgagatgtgattatttagctggttttctttactaacctgaccaatttgttggtatctaagaaaagcaatgagggacctccatcaatctctatttacctagtcaatttggaagattgagtcttcaataaggttgcttagcactttggtttaacccatgccaattagatcgattatatgatgattgattagatgagacctaaatctaaatctctccataaatattaagtccataggtcttccatcattgtagatgtgtgggcgtggtactgatgttgagcattctcgattggtcatagtggttcaattacaccagaaatatgcaaccactttattagtaaagagttgttctaaggtaaggatagggttgagcctaataactattaggtgagagacccaatgacggttttacacttgtttgtgactagtagatcggatttaactaacgagtatggttaataactgttaagtgagcttatataacttaaaaactaagtcgctacaacatgcttagagaagcatctaggcaaagagttgtccacgcatgcatattatcaataactgttaagtgaagtgcatgacattggtgggaccacagtactcactaaaaactcaattatcgcattagaattttagcttcccattcgaagagtagaaggatctgaaaaataatggaagtcattatttgcttcttaaagtctctaaagtaaatataaatttaaagtataaaagtctaacttgaatttctacttttgtagttaaactatgtcagcttcaaactctctagcctatattcttgaatccaatcatttgatcgaaatcaattttaaagactagcttaaaaatctcaggattgtcctgacttctaaaaaattagatcatgtactcgatcatgaacccctagtattatcaaatcatcttactacatactgagcaaagaacagcatatgaaaagtggatggatgaagacagtcggattaagtgctatatgctgactttcatgtcaaatgagttattgagtcagcatgagcatatgcccactgttagagctatgatcactcacttacaagagttgtatagtgagcagagccgaactatatacttcgaagtatccaagagactcttcaatctgaagatatgcaaaagacagtcagtccatgatcactgtatgacaatgatcaaggatatagaagagcttgagaagctcaagctaaatatgcaaaaagaattataaatgaatttgatctttcaattgcttacaagttcatatagttaatttattataaatttttatatgaacaaattggattgcactatatctaaattggtcaacatgttggtcattattgagagaatgttgaagagttcaaggggcactgttcttactatagaatagacttcttcatccaaaagaagatctggttggaagaagaagagtaaacccatgaagaagcagaagaaagagagtaagccaaaaaaggatattccaaagaagactgaagcaaagaaaaaatatttccatcatgatactgaaggctattggaggaggaacgtccactctatctggagagtctaaagatcaagaaggatgacaaaccttcaaaaaatatgctcataactgaatctaacataatagtttcttctacttctaattgggtattggattttgattcgagtgttcatatatgtacttctatgcagaatctaatagaaagtaggaggttgaggaaaggtaacataatcctttggatcggtaatggagtaaaaattactacagaaatcgttggcacttatcttctacgattaccgtcagaatttagattaaatttaaaagactattattttatttctatagctaattaaaatttgacttctatgtctatgctagcacaggagggttttgattttaatttcaataaagatttttattttacttatttaaaaaataaattggttgcacacagtcttttaattgataatttttattacttacatgttaatgtaaatgtgaatttaaacgagcaagtagtgaatgtagtaggtcaaaatagatctagagataaaattaatcagaagtacttgtagcatcataaattaggccatattggagaagataggataaataaactgaaaaaaatgagatctttgacttttttgattcagagtcatacctaatttatgaatcttatcttcaaaaaaaaatgatcaagttatcctttataggacaaggacaaagtgccactgagttacttgctttggtatgcaccgatatgtgtgggtcatttgatgtgcaggtcagagatagttatagctacttcatcatctttaccgatgatcaatctatcatgatacggatatatgtatctgataaaatacaagtctgaagcttttaaaaagtttaaaaaattaagaaataaagtagagaaacaaacagacaaacccattaaggttctttgatctgatcgaggaggtgaatatcttagttaaaaatttttgtgatatcttaagaacaatggcatagtctcttaatgaactccttttggaacatctcagctcaacgaaatatccaaaataagcaatatgatcttattagatatggtcaggttcatgatgagcttcactgatttaccctcatatttttagagacatatcttattaactgtaatttacttattgaataggatttcatcaaaatctattcctatcacatcatatgagatatggcatgataagaagtcaagtctagattatcttaagacttgaagatgtcaaacctatatcaaaagatagatgactgataaattagaggatannnnnnnnnnnnnnnnnnnnagatcatatgtgattgtgagtcgaaacgtcatatttttaaaaaaataatttatccaagatcgtgatagtgaaagattagttgagcttaaagagaagatctctaaagagccaagagctatagatcttcgggaactcattgttcatgagctagtagttgatgttcctccatcacctcgtagatctagcaggaccttccaacctcctaaaaggtacatggatatgcttacaaagaaagtaaagaaaatatttcttatgagagataaggatcatgatgatgatcctaatatctttgatgagatgatatctgatatcgatttcaagaaatagttagatgtaatgaagtcataaattgactcagtatactcgaaccaaatatgaaccttagtagatccatccgaaagtatagtatccattggatgtaaatagatttataaaaaaaaagaagcagatgataagatagagacctataaagcaagactcattgtaaaaggttatagtaagtgcaacgacattgacgatcaaaaaatcttctcgtccatagtcatgctgaaatctatccacactctgtttgcttttgcaacttatgattatgaaatttagtaaatggatgtaaaaactaccttcctaaatggatagcttgaggaagatatctatatggagcaacctttagatttcatatttggtaatggtgatcatcgagtttgtaagttgcaaaagttcatatacagattaaagcaagcttcttagagttggaatctttattttgatgatgcaatcaaatcgtttggtttcatcaagaacgaagaaaaactgtgtgtatacaaaaagatcagtgggagcataataatatttctcatattacacgtggataatgttctccttattgagaatgatattttcatgctgaccacggtgaaagaatggttatccaaggaattctccatgaaagacctaatggaagcatctcatattcttaagataaagatctataaggatagatcttgtcacaaaagctgtatatagagaaaatactgaaaagattcagcatgaaaaatttaaaaaaagatttttacctcttagacaaggtattcatctttctaaggcgatgtgtccgaccacatctgagaaagttcagcgtatgagtaagattttttatgcctcgactatagagagcctcatatatgctatactgtatactcgatctgatattgttcttgctgtgagtgttacgagtaggtattagtcgaatccagatgaagagtactggatagctgtgaagaacatccttaagtacttgagaagaactaaagatttatttttaatctttggaggaggttctgagttgcgagttgagaggtatactgattcagactttatgtctaatcttgatgataaaaatctatattatgaaatgtgttcgcatgcaatggtactacaatcagctggaagagttctaagtaacccattatagcagattcaactacagaagctgaatatgtcactacttcagatgctgtaaaagaaagcttctgattcaaaaaattcatcatggattttggggtaatgacatcgaataccataccattttattgcaacaacaatgaagccatagcatttgtaaagaagtcaagatctcatcaaaaatcaaagcacatcgagctacggttccatatcattcgcgaccacctcaaaaaaaatatgtcaaggtataaagagtagactttttggataacatggtagatccgctaacaaagtaattgagccagcctaaaatgaaagtccatcttgagaagataggacttagattagtgaccaattgactttagtttaagtgaaagattgttagatgtatgttctaaaagctaatatgactgacacattataataaatctaggatataattttatacttaatatgttgatttaattaataaaaatataaatttaatttttattcaagagtgatacatctttaaatcatccatgaaattaatacttggatacatattttcaaagtgtagagaattagaggcatatataaaatttctaaatgctctcgatcataatatcatgatgaggatggtgatctatccggatagatcgatacacagatcacttttttcaagatagatgagcctctgatctacagtatagagacactgagcaacgaatacgagtagttgttagaaaataactagtactaagcgtgaccatacgagaggtcacttagatttctattcgatcatcgatgattgtctcaatattgtagttgtgtgaatgatcctttgacctacaatgatatgattgctcgcagtaaagctgctggagtttgactaacacataaacatagccctgttgagatcttgtagtgaatgttggtgatagttgatccactgtaggagtaggatgtgtatctaaatagaatctattgattttgctagagagtagtcctatgaaatttgagaagctaagtccgagagtttatggccacagcagtgtgattgatgaaaaaatttttcatgaggatcacaattggatttaatctaatcaaatctatcatataattgatgatgaggtttgatgatttatccatgacctaccatctaatcaggactcatgataaaatgactgaatcacatacgaacaacacctttaggttctattttgattctactagattactactacatactgctagatgttacaggtggattatgagagctcactaggattgttcaggatcgataatcattgatgagttagaatggaatcatttcgatccattaaaaaaaattataataatattatgatagagattatagtatatcttattaccagatagaattgaatctatggagttacacaacaaagagattagatcttgaataagcaattgatcttatgaaatatcaattgggtttagaaaattcttattggattttggataaccttgctagcatatggttgaatctaattttttctttatacttaaattacttacttgataagattaattcgagttaattacatactaataacctaaataaattagaatcattaggcttcaattgttgggtgcctagaattttggatcctacctaggattttagatcctatgtattgagggtttcaatttttaatcaaatttcttgattgtttgcattggggtgccgtttgatttgatcaagttggacgtgcccacttgatagagggcatgtgggaccagtaaggggcatcccctaagccccatgtgatgcgtgagaaagtgggtgaaaaaatttcaatagttggtgcttcatggatcatctaaagagagtcaaatatctaaagctacatgcaaataagatttgtattaaggggctatttgattttgaataggattcaaactttttgcctatttaaaagagtcttctttaaggctctaagcattagattttcagtagccccacacctcctaagagctccccatgcctccctctcttctcctttttggttccaacacccaaaaggattgggcgtcctccatctccatgcccaaaaggtgtttgggcatccctcttggttgctggttttcaaacattaactgtttcataattaaggaaaggaaagcaagaaaaaaaaggaagaaaaagattaaggaaaggatcaaagagttaattgcgatccagacttcgttcaaattcataaggtaatcattcttagagaagaaagatcaatatcatagagaattattccagactgatcctgagtggatacctgtagagatcagacacttgcacagctaagagagagcctatcttcttccagatccagattcaaaaaaaaaattatgaaacagatatgtgatttgatcagatatttaatttcaatataaaattcagtatatgttcaatttcatcatatgaagtatatccatgtattttttattttatacatacataatttaaattaaaaaatattttaatcttttattctactatattatttagaaaaaattaaaatatatacgcatacccatacatgaaattcctacaggagggatggcaaatccggcatgggggatggtggggatggtggatctgatgcaagagacgacggatctagcgatccaatgtcggggatggtcgatctgatgtggtgataacaacatggggattgaggtacggggatgggggctctagcaggcttcaagcgatgcattgggggaagagtggggccaatgggaaagaaggggggaggtgggggtgcgagatgttggattcgatgtcgagacgacagtgcatggactagggcatggagatgggggctccaacagtgcgacggcggaagcaggtggactggaggtggggcaaaaatgggggacgtgggggtgcggtaaaaaaaaatcgatcgaaaatgggagagattttaaggctctatattagcaatggctaaatctatatatcgttaaagccatcactaataactaattaatattaaataaataaaaatttaaaatttaagagttatagcgatgattttgcctcactaataaacatatgtcccgtcgctcttagatgttcgaccctttaatgatggtttgcttctcgatcataatttttagtcacaaaatattcctattagcgacggctgttatgcctcgctactaatgaatattcttgtagtacaaatagatccttgataaaataaaaaaaagtacttaaattttatttctgctagtcaaaattataattattatattataattcgataaagggaaaagggtaagaaataaataaagaaaagaagaagaaaatgaaagaaaaaaaaaggagaagaaaaataaagtagagaagaaaagaaagcatgtttgatggatccttcaggatttgggtcaattctattttttttcaaatagattcttaataaaactttaaaaaaatatttagattttgtttctactagttggaatagtaattattatattataattcaataaaggcaaaaaaagaaataaataaataaagaaacgaaggagaaaaggggaggaaaaagaatgaagaagaaaactaaggtgaagaagaaacaaaagcatagtcgattgatccttcaggattcaggccaattctattttttcgaatagattcttgataaaattttaaaaaaaaggctagattttgtttctgctagttggaatcgtaattgttatatcattattcaataaaaaaagtttaagaaataaataaaaaaaagtagaagaaaaggaaagaaaaaaaaaagggaagaaaaatatagtaaagaagaaagaaaagcatggtcgattcatcctttaggatttgggccaattttattttttcgaaacaaatccttgataaaattataaaaaaaatacttaaattttatttttgttagttgaaatcataattattatattataattcaataaaaggaaaaagagaaaaaaataattaaagaaaagaagaggaaaaagaacaaaagaaatgggaagaaaaataaagtaaagaagaaagaaaagaatggttgattgatccttcaggatttgggtcaatctatttttttaaacaaatccttaataaaatttaagaggaatagtacttagattttgtttttgcttgctggaatcataattattacattataatttaatgaagagaaaaaaggtaagaactaaataaagaaaagaagatgaaaagaaaaaggaaagaaaaatatagtaaagaagaaagaaaagcatggtcgattgaacgtttaggatttggatcaattctagctttccctaactaatccttgataaaattaaaaaaaagcacttaaattttatttctacaagttggaattgtaactattatattataatttgataaagaaaaaaagggtgagaaaagataaagaaaaaaagaagaaaacaaaaaaaagggagagaaaaataaagtaaagaagaaaggaaagcatggtcaattgattcttcaagatttgggctaattctatgtttttcaaatagatccttgataaaattaaaaaaaaacacttaaattttgtttctcctaattgaaatcataattattatattataattcaataaagagaaaatatgaaagaaataaataaagaaaatgagaagaaaataaaaaaaagaaaggagaaaaaaagtaaaaaagaaacgaaagtatgtcaattgatccttcaaaatttaggccaattctatcttttccaaacaaatctttgataaaataaaaaaaatacttgaattttgtttctgctaattggaatcataattattatcttataattcaatgaaggaaaaaaaggaaagaaataaataaagaaaagaagaaggaaaggaaagaaaaaaaataaagggaaagaaaaataaagtaaaagaagaaagtaaagcatggtcaattgatccttcaagatttggaccaattctatctttccaaaatagatccttgatataataacaaaaaagtattaaattttatttctactagatagaattataattattatattataattcaataaagaaaaaatggtaagaaataaataaagaaaataagaaaaaaaaagaagaaaaaaagaaaagagataaaaaataaagtcaagaagaaagaaaagcatggtcgattgatccttcagggtttggaccaattctatctcttccaaacagatccttaatataataaaaaaagtacttaaatgttatttctcctagctagaatcataattattatattataattaaataaaaaagggtaaaaataaataaagaaaataagaagaaaaggaaagaaaaaaagaaaggagaagaaaaataaagtaaagaagaaagaaaagcatggtcgattgatccttcagaatttgggccaattctatatttttcaaacagatccttgataaaattttaaaaaaaaatcttagattttatttttactagttggaatcataattattatcttataattcaatcaaggaaaaaaaataaataatgaaaagaagaagaaaaggaaagaaaaaaagaaaggggaagaaaaataaagtaaagaaagtaaagaaagcataggtaatcgattattcaggatttgaggtaattctatctttttcggatagatttttgatataatttaaaaaagagcacctaattattatattataattaaatgaagaaaaaatagaaaaagaaataaataaagaaaagaagaagaaaaggatagacaaaaaaagaggcaaaaaactaaagtaaagaggaaaaaaaagcatgatcaattgatccttcgggatttgggctaattctatctttctcaaacagattcttgatataaaaaaaagcacttcaattttggctctactagttggaatcataattattatattataattcaattaagggaaaagggtaagaaataaataaaaaaaagaagaagaaaaggaaagaaaaaaagaaaggagaagaaaaataaagtgaagaagaaaggaaagcatttggatcggttgatccttcgggatttgggccaattctattgtttccaaatagatccttgataaaataaaaataagtacttaaattttatttctacaaattagaattataattattatattataatctaataaagagaaaaagggtgagaaaaaataaagaaaagaagaagaaaatttaaaaaaaaagaaaggtgaagaaaaataaaataaagaagaaaggaaagcatggttgattgatccttcaagatttggatcaattctattttttccaaatagatccttaataaaatttaaaaaaaatacttaaattttgtttctactagttggaagcataattactatattataattcaataaagaaaaaaagagaaagaaataaataaagaaaagaagaagaaaaggaaagaaaaaaagaatggagaagaaatataaagtgagaaagaaaggaaagcatagtcgattgatccttcaggatttatgctgattctattttttttcgaatagattcttgataaaattaaaaaaaaaacttagactttttttcctagttgcaatcgtaactactatattataatttaatgaagggaaaaggggtaagaagtaaataaagaaaagaagaagaaaaggaaagaaaaaaaagaaaggggaagaaaattatagtaaagaagaaaagaaagcatggttgattgatcttttaggatttgggccaattctattttttctggatagatccttgataaaattttacaaaaaaaagcacttagattttatttcagctagttggaatcataattattatatataattcaataaataaaaaataaataaataaaaaatgaagaggataaggaagaaaaaatgaaagcgaaaggaaaattaagtaaagaagaaagaaaagtatggttgattgatccttcaggatttgggccaattctatttttttcaaatagatccttgataaatttttaaaaaaaagtacttagattttgtttctacttattggaatcataattattatattataatttaatgaagagaaaaagggcaagaaataaataaagaaaagaagacaaaaaggaaagaaaataataaaaggaagaaaaatatagtaaagaataaaagaaagcattttaggatttgggccaattctatttttttcaaatagattcttgataattttttttaaaaaaaagcacttagattttatttctgctagttggaatcgtaattactgtactacaatttaataaagagaaaaaaataaataaagaaaataagggaaaaaagaaagggaaaagaaaagggaagaaaaataaagtaaagaagaatgaaaataatgatcgattgatccttcaggatttgggccatttctattcttttcaaataaaaccttaataaaatttaaaagaaaaaatactttgattttgtttctgcttgttggaatcgtaattattacattatatttaatgaagagaaaaagggcaagaaataaataaggaaaagaagacgaaaaggaaacaaaaaaataaagggaagaaaaaaatagtaaaggagaaagaaaagcatggtcgattgatcctttaggatttggatcaattctatctttcccaaactgatctttgataaaataaaaaagcacttaaattttgtttctactagttagaatcgtaattattatattataattcaatgaaggaaaaaggggaaagaaataaataaagaaaagaagaaaaggaaagaaaaatgaaaggggaagaaaaataaaataaagaagaaaggaaagcgtggtcaattgattttttaggattggggctaattctatctttcccaaatagatccttgataaaattaaaaaaagcacttaaattttgtttctcctaattggaaccataattattatattataattcaataaaaaaaaggaaaaaataaataaagaaaatgagaagaaaaggaaacaaaaaagaaaggagaaaaaaagtaaaaaagaaaggaaaacatagtcgattgatctttctcaaacagatccttgataaaatttttaaaaaaagtacatgaattttgtttctattagttggaatcataatgttatcttataattcaatgaaaggaaaaaaaaagaaataagtaaagaaaaaaagaagaaaaggaaagaaaaaaataaagtggaagaaaaataaagtaaaagaagaaagcaaagcatggtctattgatccttcaggatttgggccaattctatcttttcctaaatagatttttgataaaataaaaaaagtacttaaattttatttatgctagttggaatcataattattatattataattcaatgaaggaaaaaagggaaagaaataaatgaagaaataagaagaaggaaagaaacaaataaacaaaaagaaaagtaaagtaaagaagaaaagaaagcattatcaattggtccttaagaatttgggtcaattctatctttcccaaatagatctttgacaaaatttaaaaaacttaaattttgtttatgctagttggaatcgtaattattatattataattcaatgaagagaaaaaaggaaagaaataaagaaagaaaagaagaagaaaaggaaaaaaataaagaaaggaaaagaaagataaagtaaagaagaaaagaaagcatgaccctttaggatttggatcaattctgtccttcctaaatagattcttgataaaatttttaaaaaaagcacttaaattttatttttgctcattggaatcataattattatattataattcaatgaagggaaaaggggaaagaataaataaaggaaagaagaagaaaaagaaagaaaaaaaaagggggaagaaaaataaaaaagaaaaaaaagcaaggttgattgatcctttaggatttgggccaattctatcttttttaaatagatccttgataaaattaaaaaaaacttaaattttgttttttctcgttggaatcataattattatattataattcaatgaagagaaaaagggaaagaaataaatgaaggaaagaagaagaaaaggaaagaaaaaaaaggagaagaaaaatagagtaaaaaagaaaggaaatggtcgattgatctttcaggatttgggccaattctgtctttttcaaatagatccttgataaaataaaaaaaactacttaaattttatttttgctatttggaatcatgattattatattataatttaatgaagaaaaaaagggtaagcaatagacaaaagaatagaagaagaaaaggaaagtaaaaaagaaaggggaagaaaaatagagtaaaaaaagaaagaaaagcatggttgattgatcctttagtatttggacaaattctatcttttccaaatagatccttaataaaattaaaaaaacttaaattttatttttgctcattagaatcataattattatattataattcaatgaagggaaaaagcgaaagaaataaatgaaccaaagaagaagaaaaggaaaaaaaaggagaagaaaaataaagttaaaaagaaagaaaagcatagtcgattcatccttccggatttgggcccattctatcttttccaaataaatcattgatgaaataaaaaaagtacttaaattttatttctactatttgaaatgataatatcatattataattcaatgaaagaaaaaaaaataaataaagaaaagaatggagaagagaaataaaataaagaagaaagaaaagcacggtcgattggttcttcagaatttgggctaattctatcttccccaaatagatccttagtaaaattaaaataaaaatatttaaattttatttctgctagtaggaatcataattattatattataatttaatgaagagaaaaagggtaagcaataaataaaaaaaggaagaagaaaaagaaaaaaataataaagggggagaaaaataaaatgaaaaagaaaagaaagcatagtcgatggatccttcagggtttaggccaattctattttttccgaatagatccttaataaaaatttaagaaaaggcacttagattttgtttttgctagttggaatcttttagattttgtttctactagttggaatcgtaattattatattataattcaatgaagggcagaagaaaaagaaaaaaagaaagaaggagaaagaaaaataaagtaaagaaaaaaggaaagtatggttgatcgatctttcaagatttggatcgatcctatcttttccaaaaagattcttgatatttttttttaaaaaaatacttaaattctgtttttgctagtttgagtcataattattataactagcttagaacctcatacgatgcatggtatggaaacctcaaaaacccctttaatatctcttaagtactctcctttcccacgtacctctgaaaaaataatgaaatgaaaagaaaaagaagtggaaaaaaataatcatctatgtggagaaaggtcatatccttaatatttttccatctttcctatgtttttgttgtttttttccatattttcccccatttttcctctattttttccatcctcaggagtcccaaccaggtgggaggcttggagtggccggatacgaaagcttagatgatggcaagggttttgtgttggatatttttttcctttgggctcataggcgatgctactgtcagagacaatggtgaggcataccgccgtcatctcctgcgaggcaacctccatactgttgtcaccctcggcctccttcccacctccgatttctccaacccctgtctccatgcctccctcaacccctcaatcaccactatctccctccagatcacttgcactacacaccttgctcctaggatacatgccttgccgaccctgatcatgcctttcgtcttgcctacaccaccctcctcctcccctttgaaagctatgggaggcggaaggttcaaagtaaaaaaaaaaaaattgccttcggaagctatgggaggtagaagaaaaaaaatgctatcttggacacgtgatggatagtgccttgagaagaaatacatacgtagcagacaaaaactgatgccaccattttgatatatatattaaatatagattaggtaaatcatccactctattaaaaaacttgcgactgtcctctagcccgtcacccacacaagctaggtcacttgtcaatctccatccaccgtttcttttgatatgtttaataattagatcggatcataactcaacctacttggtctatttaaaatctgcttaatctatttttgattaattttacccgatccgcttagcatatttgactcattgaatctgatttaatctatttaataaatagatcaaatcagattatctgtttaataaatactttagattcagatctaaatttttgatccatgtaataatcagatcagattcgaattagcaaattttctctttgatcagcatccaatttgaacaatatttgtttcggtctaacccaactgcctccctcagcagaaatgcaaaagacaacccactcactcctttgctcagattattcagcatgttactgaacctcgaggagggatttagtactcatctattgcctaagcactctacactgaggggttatatctataatattgtactgctgcttaatttccgctcttctcaatatgtaatgtctccactgttttcttatttcactatccagcagtgcttattggtcattgcagttgcttactggtgctcccgggagctctctattgtctactgcttttggtgccaaggaattacttcttctgactttgtacaacatgttctaactcacaggcttttactctttacttggcatacagggaatcatactaatgattatgcctgctttatctcttggcacacttataccagcacttggcactcttacagggaatcacttgttatagtggagggcttgcaaggcatgtcatctcagtttattgaattaattatgttcttctttcttaactttgcgctgctggtaataatatttatgggttcctggatggagatgatgggtggcacctgctggtcacttatgttaccttttcacagtatatacccagatgatgttttaactgcatggttcagtctctgtatattactctcctccactcgtaagctatggcattttgattggcacttcatttacctcccaaatattgttccttataccttcgttgctgttgggagctggcccttatctcaaatatccattattcattaggtattggaatattctcgtttcttcaattcagatgcactttcaggtattgtttatgcacttccaggtatggtctggttcatattgcaaatcttgtatggacgttgctgcttacatcgatcctgctgccatatttatttcatcccaaatgatgttcgactgcaagtgactaccgatgggaatggatgtctaatttatttatctcccatttctgaagcttttagtcgctatgaattaaatgtcccaaatgatgtttcactgctgcatataactgatgggcctgaatgtctgtcacgtatcttcacttccttcacattactcttctaatatgctactgctgcctgccatgttcgcaagtgctctagcaatcttactgtgtttttgcctttttacatgtaaattctggtcatgttacctttagaaactgttttgtatgtctctgtttttaaacacatagcagcgcagctctgtcagccatctgtacgctgggcttcattttttggctctgtaacttttaatactccataaataaagtttcccaattctatcaaaccaaaaaaaaaaaaagacaacccgtcaacacccaaatgcccacccatccataagttgacaccatcttttttttttttttaatacaaatttgaccaggctcgcgagtaatttcgagaaggagcaagaatgttctggtaagcccatcgatttgcccagctccaaaaaaatctaaataccacggagaacacgtgtagtccggcaaaattctctccctcctcttcccgtcgttctctccaataagtggaattaagcttaccaaactcttgccggatttaaagtaaaaaataattaaataataattggtcgtcaaatccaacggaaagtctctcctaaaccctcctcctcactctcccccaatggcccgtcccctctctccgaagtccgctggtgaggaggagaacaccgcccaaacccgactgtccgatagatggggcacgataatgtggctcgcagtcccactccagggcatcgttaagagccgagggggcctcatccttggctccctcctcctctacatcctccagctctatctcaagtgcaagaaccactcctccccctccttctctgccgccagcatcttcaagctccccgttagcattgctcggaccccctttcagggtctcctctcttcgaaaacctccatcggcccaagacaatttgagtatccccttttctcaaaaatgcaacgccacgtgcggcccactccgcttataccaaaaacccaagtgtcaaacggagacagatgtctctgtttttattatatatatatatactagtttataatttcatacgttgcatgagatgtgattttttttaaaataatattttattttatttatttattttattttattatatattttaaaaataattaaaataattaaaattttatattttatgtatagcgtgcattataaattattaaacaaatcttgtaaagaatcggcagttttgattctataaatttttttctcaatttattattttcttactatttttatttttagtcattttatcaaataaaaatggatgtaattttatttttttaaaaaaaatctaaccaacgatcgattaagtcaacttaaatgggataagctcacctttactcatctcccaaatagaatttgattagataagctcagaatatattttttaatactaaatttattttaaatagcattggttaaaattctattatgtgtgcaactgtaccaaaaaaaaaagatcattatgtatgccatcgtcgcctacaatggaaaagcaaacaaaaatcccattttgctgcctgttctgattttgtgcgcaagggttttcttcccctacaatcccctcccccacccacactctcctctcacaggtagcccagtgtctccccctcgccagtcatcctttttcatcgatcgctccacttataaagtcgatcataaagcgatgggagactctcaatacacgtcgctaaccaccttcaaatactcacgattccttccacctccttcctactttttctcaaaccaagtccgaaagtattaaattatgaaaaattttcaatggcctccatccaactcctccaaagagtgtgtgtgtgaccaccgattggctccgactgaagggggatggtgagaaggggcaagggaggtgggtgagcgtggctccgcaaaaagatttgattggaatattggggaggcggagcttttcttcttttcatccaccgtagcgacaatgaccatcgtatcacaacccagttgttgtttttgtacgtccccggcatcgaccttcttccatggaccccttcctgcggctccatcgtgcctgcacaaagtgtaggatctaaccctaggatccacgctcccagcccactcctcccacgaccctccgtcattcccctgggcgaaaccctcgaatcagacttttggtgccctaccgtggagaactccagccttgacctccgaattctccatcattttttgatccaccataaagagagaaaatgagagagagagagagagaggagttgagacaggagcaaaggcggcgaggagagaaggatcgaaccgaaacgatgggagctctagccccttttttttgttttttcttcagcgtggcagatgaagggacatgtattttatacacgtagcaaatgaaggcttttcaactgaaaaactttcattttaatatatatatactagcttaggattccatacaatgcatgagatagaaactactacctgtaagtgtcaaagtcacatgctactttcaaacaaacatattctcttgatttaagcagtaaaaaaatatatttttttttcaaataaatatattcttttgattctgactttatcactcagaataatgcatctgtgcatccaactaatattaatttttttttgataaataactaatatcagaatttcaaaatataaaggttaaccatacatggcaaataaccaagaaaaatttctgttagagaaacaataggcacattattgatgtgaggtgagctaggatctattgttaatcttttgtcagataaaaaataaagttttcaaaaccccaaccaaccctccaccatccttccactccagtaagtactatccactcttcccctcctccccccttcccccctccccccctccatgaccctttccacctccacccactcatatatcaccccctccagctccgtcgccaccgcagcccccagccccatctgcctctccagcgccactgccgacgtcgccgccagcacctccctcgccagctccaatgtcgttctctcccacccatccaccgctgtgtctgcttcggcctccaacaatgcctgcactgttgctgcttgcttatagcccaccgtcatgtacattggcatcagccccccaccggccctccccactcaccccatgtccgctctgactgcaatccagatggccctcttgcccttccccctaccctccaccatactttccatcttcgcccacttgtataccgcctcctccagctccgctgccaccgccactaatcccactcacctctctagcaccaccatcgacatcattgccagttccagtgtcgttctcccccacccatccgttgctacgtccacctagacctccaacagtacccacaccatcgctgcctgcccacatcctgctgccatgtgctatggcgtcagccccccaccggccctctccgcccgccccacgtccactctggccaccatccagatgtccctcatcatctaagcttccgtgtgcggtattgttttttctgcacgaatcaacgaggcattggctccccactttagtattgtgaggccttctacgtggcttcctcccctttccctaaaagcccacgtgtcagacggagacttctcatccattttaatatatatatatatattagattaaatttaatgaagaataaataaataaaattaaaaaaaaaaaggaaacgtaaaagtagaaaagttaaagagagctaaatcaccccctgcggaagcaagcaatgagcatgtaatgaaaatttaatttcctttgcggtttcttctatcttttcgtaaccattctgtggcttctataggaggtcaggactgtatacaagaattagatactgtcctgtggtatcaagagcataaaaaacgctctgttccttggctacaattaatttgggattatgtaagcttcaaatgtctggacctttataaacccaatggaattctatttcaaaggcgaacccttgggagcatcaaaactttgagaaagaaggtgttcgcgattcgcatttgaaatgcgctttaacaggcctatgaccatgatgaacgccgaatctagaagaggacttgagctctgtcacctcccaactcgcctcgttgtcctgcccctcattgtgatcttatgctcctctttcttcgtttgtgaagggaaaaggacggaacaagaagcttccctccgtttcattgcaaagaataatgtacaatccttcaatgacttcaagccaaaggttcctgaagttgaggtgaagccaactggtatcgaggactttgctttcggactctttccctctccttcactaaatctaacactaggtttagatgttggcattatgaaccccaatcctctaggctttgagtacgctaacgcaaccacttcgatatattaccgggaggaacttatcgggcaggcactaatcgcggcaggaaaaatcgatgcaagttcaacaatgaacataagcacagtggtactgtttcaagtggaccacctgatcacaaacaagcatttcttaaaagatatcttttcaggttccttgaattttacagcatcattgggcatcgaagggcgagtgatcgtctttaagttcgtcaagatacatgtgtcagtttatgtatcatgtgatttcaccattttccttctgaaaagaactagcgaacatcattgcaaatcgactattaaactttgatattctttttcctgtttgaaagtaaaacaaaaatgaagtcatgttttaatgaaaacgttcagcggtaactttccggaaatatttgtttgatccttctgatgtgaaaagtatcagtggtaacttcctctgaatttattgaatcttttttatgggaacttaatattgatgtttgatatgacttggatgggatgcccactgagattatgcctgccaccctggccaattaatagctgagtgatatacggcatgtagaatccttgacatgatctcagaacatcagataaaaaatgatgagaccatctacagcagcacaaaagaaaagggcataatagcctcgtcgaagattatgcgactagttcgtgacggactctcaccctcctctctatataaataaggctaggagactccagatatgagacttttctcttctatctcacctcattgctcatctcagatgtccattgttccttccaaaactctgtatgacccttgattacttctcatcattggttggaggttggttcttgtatcacatagctcaactccggccgtgccaagtagaccggtctctccttatcggatcacgtaacttcatcgcattagattttgggcagcagtagtgttaatcagttggaatgaactgtagattacactatcgttttttgcacctttttctaatcaagtggcctgatttttctagaatattggagcaacacgccaagcgcgtcgctgtaaaaaacactcactccctgcagaggtaatggacaaaaatacctgaattacaggttcaagtcctagataattacttcagtcccaacaagggagaatatgggtccatttctcacctgatcctgaggattttgtaaatggactctaataggatctatacctgatacttgggtcaaggaatccaaatatcagagaccttgaacaattggaaacgagtcatattgtggaccacgtcttatgataagtttgcagatgtgacaagtctaaaaaatttgatacattcggtcttaccagcagaacattcaagtatgattagtagttggtgatttctcacagcgctagtaactactacaatcaggtgaaatagagcacgactttgaaacttgagacgaagacagattgagaaaggtgatccttctttttcttttttgctgaacggaaaggagggcagtgcatgctcacatagatcatgaaatcgcgtcatgaaaattagaaaaagatcatggaggtggagagatggatgggctgtgagttggggccaagttctggttcttgacatatatagggcccatatgctttaccccatggagaagaaaaaaaaaaataataataataataacaaaagttacgaactttaaggttggacttcgggtttgcaaggaggcctacaaatacctgggccccttcagccttcctttcagagttcaacctgagccctaattaacatacatgcgaggtccctatactgtcaaaccaatcagcagctgccacttaagcacacaaatctgatggttggatctgatatggtcagcatacatgtgcccttgacgtgcctgatcgcccgttacttgttcacgggagattggattaaatacagacgggaaatggggtagctagctctttcgaagtcttcaggcccatcagcgtccaacattccttgcgctccaacgttccagccataagatgggtaacctccaaaagagatgggagaaacgcgcagcacaatacaaacggatccttcaaggaacggccatctaggaaactccatccttccatttcctactctctattctgaccacaactgaccccacacttcgttttcatctccacaaacttactcccaacaccaacatcaattccttctgccagacaaagccttcgaacaccccttatttaaattgcacccaccttgcaagcatcgtggtatgcccttcccatccatcaaacttccatcccctcttcatcattcctgggaaagtctccaaggcttatcctcgtagactcttgaaggatatccaagctttgagcctcgaggcagctgccggtttgctttgtagtgattcaacaagactcggagatcatgagaagtactcgaaggtgcctcatgatctgttgccttgtgacgtctatcatcattattctccttattgtgactcttgtgatcttatacttcaccatgttcaaaccaaagcaaccgcaaattgtggcgacgccggtgaatctccaaaatatagaatttcaattgtcaccctctccgtcactaaacatatcgttaggtttagatgttctcatcaggaaccggaactatgcaggctttaagtatgataacacgacgactttcatctactaccgaggggtgttggttgggttggcaccaatcgaggcaggcaccatcgatgcccgttcaacagagagtataagcaccgtggtggatcttcaggtcgagaagatcatctccaacccctctttcttgccagatgttatttcagggtccttaaatttgacatcctcatcggagcaggagggggatgtggtccttctcaataaattcaagctacatgcgtcaactcttgtctcgtgtgatataagcgtttttgtctttacgagaaacagcagctccatctgcaatgcaaaagttagaatttgattgctttgttttcttcatttttattgaaattaaattcttggtggccgttgttactttttgacaggaaaaaacacacttggatttacattttattgatggctttgcgtccatattcagttggaattctaattattatattataattagattgggagaggggggaaaggaaagaaataaggagacgtttggttcgccttaaatggagggtaaaaatgaaaaataaaaaaaaaagcctcttttattttattggagttttcaatggagacaagttacaaaaaggtgtctatataaaaaaataattcttatattttatgaaaaaaaaacttcacgaggacaaaagaattttgaaattctcatgaaataaaaattgaagatttttttttcaaaaacattcttttaaaccatcaatagacctatagttagaatgaatatgctctccatcacgatgcctcaaatccttcactaagatctagccaaaaatattcttaaccattataatttttcatttacaagcaatgtaatgtacataatagatgagatttttcattatattaaggaaataatagatattttatatagtttttttaagaaaatggatgcttaatcaaaataagccactttaaaataagttatttctctatgtcaatcaactatgttaatactactttttcagatatcatattctcataaattagctttccaaaaataatatttcaagaaaaaaaaatttcataaaccaaaatgagtcctaaatgaagataagaagaagaaaaagaaaaaaagctaaaagacaacaaaagaaaagagaaaagggaaaataaaagaaaagtaaaggaacctaaacgagaataaaaatcatatggggcgggcactagagaaaaaattatgggacaagctttatagtttgatgtgtttctcttaatataaatcttaaagaataaatttaaaaatcaaaaatatttctactaatgaagttatcaattctgtgtttaaaaaaaatatagtattcttttttttcctcattttcagcatatactttttatcgatatataatagatgactatatgatacatactaaattaattaattaataaataaattaatacatacctccaaatacataccaattgaggttttgggggaaatagactagtgcatgcacatgcgtgtgctcaacttggccggctaagccatgtacattaagcgacaaacgcaagtacgtcacatcatccatacatttttaccatcaattatcttcaaatccatctcatctccttgattattcggataaactttataaataggttttgggtccagagccctaggatatgcacaacctcacatccactgtctctctggtgctctctttcaagggctcatcaagggtagaagaagagacggtggaatgggaacttggcttctgccttccttggccatttttgcatataagctgctgacccgatgtaggaaaagatggattgattgttgcgacagcagtacaaattttgcttcgaaaagaaaggtgaagttcctttcccagcttgagagcaaagaaaaatactaagtgcgggattttcctcgtcaaagcataaatgctcatacaactacatttgaggaagatttcccgcccccccccccctccttttttttttaagagaaaatcgtaagaccgtccaataattttagaaaagagtctattttatgccatccgggacttaacgctgcattcggtactgcgttcaaggtaagtttgtggcatccatcttaatcttccagataaaaatgacaaatatttgaacccactacgtctagcccagtgaaactgcatcttaacctgttgcgacatggaatgggtgattgggtcttgagctggcccatcccaactcaatatgtacaacaagttttatgacaccactaccttgatttacaagacacgagtattctgaaggctggaagcaaaggatgacttccaggaagcaatgcaacagaataggtgcaaaagtacttgaaagacaattctgaacatacagagcccatatgctttactccaggtgctaagatatcgcgggaaaaaagaaacaaaaaataatggttaggaacttaaggttagacttcgggttgcaaggaggcccacaaatacctcagaccactacaacttcctttccgagttcaacctgaaccttggttccactcggtttttccttcatggcaaactctcatggtttggtgcttctgtgctttgttctccttgcatcagtggctgctgcaacacaattcaaggtgggaggctccaaagggtggtctgtgcctgaccccaactcgatgtcgttcaaccaatgggccgaaaaaaatcggtttcaaattggtgactctctacgtaagttaataaaccaatcaccacttccaattcaaatagaagacggttaaaatctacagctcatgttgacactggatatttgttaatgttgtagtttttgtctacctacccgaccaggactcggtacttctggtggatgcgaatgcgtacaatagttgtgacacatcatcattcattgatcagttcgatgatggtaacacggtatttacgtttacgcgatcaggttccttctacttcattagtggaaacaaagaaaactgccaaaagaacgagaagcttgtggttgtggtcatggcaagccgtggcaatggaacaagcctagcgccccttccccggtttcttctccatcacctcctgcacctccttcaggtgtgatagagccggtaccacaatcagctcctgctggtgagtccaccactccacctccaaatggggcttctgtaaaggttgtgggctttatgggcacacttggtgctctcctcgtgacattctactatgttttttaagcgtcttttgttgagagcttatgtttctggaattttttcatttgggttgagtgagcaattgtttggttgatggtgaaggtacgtgaaatttaattacttggctcgtatgagaaattgcataactcataataagcttagcttggttaatgagagatgattcgatttatttttcaaatttcagtagcttgatttcgatgctggccatcccggtttgtaacacaagccgcaggcaccgttcattggtgaaaacacaaactaaactaaaagcccttttggtagcttttgttttcaatttttattctcaatgtccaaaaggtaaattggaccagcctaaactaatatatatcgtgaaacaatttttttaaaaaaatttaccttaaaacattaagagaaaagatttattacttttaaaaaatgaaaataaaagttaggaacggcagaagttattgttgaaattccatctccaggaccaatcctcatgccctatttcgctgacctgcctagaaactcgaacaaaaaaagcaataacggtatcaaacacgccactaacgtacaggtgaaatgtaacaagcacctatgttcaaacattgtcttaattttgaatgttctctctagtggtggtattaactaacataataatgatgatgaagaattcctgtcacaaggtccatcaatggcagctgaaagaaaacaaatgttccaatcaagaattcgacttactctttttatttctacaagggcggagtctttcaccaatacagggcctgcggttctcaatacgccgtccaccgcatgctcgcacctgagaatgtgcacacacggccggcacatcctcacacgctgcaagcgtgcccccacacaagccccccacaccatacgcccacccgctcaccataggagtattgcccctaatgcaagtaacggttagaatttgtctaatcggaggactccaggaatggttttgggaaccaatatttttaatacatgcatttgtccggttttaactacactggccaatgcatgcatcttgcgacaaaaagattcatctgccatgagtaaaaacataaaaacggaattgctagctaggggaatgagcaaaactttggaccccttctacaaccaaactttcaccttggcccatcaaaactgtttccctaattcaacctttctcataagccggattgtattgtgcaggatagaatccaatattccagcaacctgaatgccataagatcaaaattttcatatacattcaacagtagaaaaccaaataaatcatctaaagagatcaagtgcaaaccgtaaaaacacctccgatgatagcacaaacatttgtaatgaagtgtgagaaggattttggaacttcagttacgaagacctaaaattcaacataaaaataagctcacagattttgaatttgataaatgtgtaatgcaagtgtcagaaacaagcctgcatgggagagggctcaaaatggaatttggcagcaggaatatgcagactgtgcaccaaactactgtgggctgtatactcatactcctctagcaatttaaactcccgagaagattttcttgatgctgtctcagtctttacaatttgaaggtaatgctcaatctgcaaatccaaagagggtacatttagatcttcctgccaagctcctatttcataatcagcgtcgtccaaacagataactcctgttcattgccatctgacaggtgattatcattagaaacatcaaaacagtgtaaaaataggaagtcaatattgcacttcctgtccaattcctcacaaataagttatcacttggtgttcatgctgctaatgctaaaccatgcgttgacttctgatatcatgatggagcatcaaaaagtatcaagttatctgattaatcagaaaattttaagtacatagaaatggttccaagacttacagtagcatttgcattaacatcatcagcatgattagtgatgtatgatcggcctgttaatcgatcatggcttccaccaacaaagggtgatagcctcttcacttcagacagcatctgtggggagagctgcttaccaaatgaaaattgtgaaatgacatgcgagacatttatttgagatggatcaaaagagtgtgctcctgagtgggctgagatgacaaggttacctggaacctgcataatcaggaaatagaaaagaattatacacttcatcaaaacaagtaaattccatggtttattcaacttcaccgttgacatattcaggccaacaataaacaccctaaatttgtaatgaaacagatggtgatacccagatatacatatatccaacaagcttcacccaagtaatctgagccatatttagtaatcacacttcatcatacattactaacatctggtccttcctccagatcctattttggtatttgtcctctttaaaaataaggtaaaccatagtccaattacctcttcagacaggagatattcgaaggcaaggtgctctaggattgaaaatgacaaagaacagacaaattatttgagcttcaaagaacattctattactgctctgtaaagctgagaagaccgaaatcaagattccgggttgggggaatcatatgctgatatagaacaataggaagctgatatagaacaataggaaggcatgcataggtagtgagagtagtgaaattcaaaaattctagataccaattggttaggccaacatgcatgtttgcatactattaacttgtcaatttgtggtgtaaagattgttttccataatgctgatgaaccatctctgccttgacgtggttgatgcattatctctagaaacaggtttatggatgctccttcatttaataaacagagatgtcaaaaaggcgggagggctaacacagtgctgattgataatagggtttgaggggcttatgagaaggaagaagcacaacactagaaaaaccaatgctaccacttgtgtcaatctaatgcaaaaaatacatgaagaggcagatggctcacagcatactagtctttgatctcattaaatataacatggtaacaagtcactattttgttccatccaccagatgttaactctttctatccttggtgtggtctctctgattctaatgacatcattaataagagttgttcatattaggtactccagcaacctcattctttatacatttatttaacataatctaaacccctctagttgtccctcatttttgttggtctgcttatatctttcatgtcctcatttgagcttgagaaaggaaaaatataataatgtgtaaaatgtatatggaaaaatgaataattaatttaaccaggacgaatttatatatttgctaaagcatcacattagtcttccagataacaaattaaatgccattcttaccattctgagtacacttttatcacaaaaatcaacaattgcatgacacttgatgtcaatgcatcacatctttgtgagttgaactgtcagtttcatcacagagaacagcaccgcacctagatgagaaaaggtttaatggttctagtcatatatatcagaacatctaagttaagaagacattgaatcatctacaaatcaattctggtgcatatgatataattttcatttctgaaattatctcccaaacagcctatagtattgtttttctaagacatctatagaagattctacaaactcaaaatggtgaattaattcaaggcagaagcttattttacctttttgacacgcacaaaaccttctattctacacccactagtcaacggtgcaggtcgttttgatgtatcaatggtttgaccagatttgtcatccaatgcctgtttatggaactctcttggaacaggtgcaaccagaatttccattgcctaaaattaagaacaggagcaaccagttatcagggctagcaaataaaaagacaatatatatgcctaattcttatgatagactagtacattatgaggcattgatttgcaatgacagtgcggatgattaattactgcacgtcaaatttaaattgaaacaataagcataccacaactaaactttctgtgtcccgttctccataataagattcatggtcatggtgtccatgattttccctgtggcagatgatacggtaattgcaattatttaactaaacagaaaatgagataataacaacatgacccttaacattctaaaagactacttactaacccaggaaaatggaagacagcagaagttaattgacagcatcgacaaaagctaattcagccttgtagaaaatgcagtactagaaactttacaagcatgagtgacaacactttaagagtaacaaagacaattttaaacatatcaacaggataaaaagataaaacaaaattgcaggcggattttacttatgcacaaagctcacaggactaggttgcccataacattaagtatttactcaatgcttgcttgtttcgcccttcatataacaggatttttttaataattatatcgcacaaaaagaaggctcacatagaggaattttagcacaatttttttttcaaactgtaggagttctagaagcagaggtgatgcatattaagaaagaaaaatatctcaggctaaatattcccccgtttacgggatcaaaatagatggtcgtgctcaaggagggtacgaaagaaacatttaggatttgggcatgcttaagataattcaatgtgtaactaaaactaaataatatactctccctgatacttgttacattgaacctttatttttggaagacctattatgcgaattaaccttttaagaaacagtgatataaattaataagcaatatgaagagggctcgaaagagtagcaatgtagctcaaaattttaaataacagaatggcaacaggataaaactggaatctagataattactggactaataataagtgacactaaagacttctcagaagagttgcttggaaaggcatgatgagtctcacatagatatgaactgcaatttctatttaaaaaagaaaacatgaataataaaactgcatgttatgagattaataatgatccaaagaaatggcaagttttgcttagtttcctgcttacttaacatcactccctctgcggaaaatgcgaatggatgggtagccctggatatgatgcctgcacagatttcaaataaccaaataatgctcaatcttcaacaagaagaatgatacaaccaccaaacttataaagcaactcggaaggaaacttctacaatgacatgctattgcatcatcattttaatgtttgtgtattgcgaagtccaacttttattcatagaacatatggagcattttcataaatatttaaaaaaaaaaaatctcttgactcaggagattaaataaatgttctagagttctacaatggaataaaatgtatcagacttttgaaaagaaacttcttatgtaaaacttatcttacaattttgtagtttctttttgaactgttgcgatatattcgctcttgctgtttttgctcattcttttattctctgctcttttctccgcttctttcttctaaaaactttccttttcttttccttttcgcattccaaattaaattcttttttttagaaaaagaaaaagctaattaaacgacaacaaatatattaaatttataacaaatatttgcactggtattcaatcagatcgtaataacttcttcaaaatggggtgggtgggttttcttcgtttgctttttttgtggtgaggaaggtggggttgcacaaaattagattctcaaaattgatatctctgtcctgaatgttctagcttagactgaacagcctgataattcttacttcaacatatgattaaatttgcaagcatactttttttttcgagcacactttatatctattgtcagtcttttattgaaataaagcactaggtttcctatctaaccagtgataaaaggtgttattacatacaacggtcagtatgattttatgtcatacagtgaataccccttcacaaggttagtgacataggtctgtgcgtgtatcggcccctatcaatgacattcagcttttgttagactatatttctgcatatcaccatgatgcacgacaagtcagaatggtatagtaccccattaggcaacaaacattgataaacttatgtatccactaaacacaatgcatatcaaacataaaataattctgaaattattaattatgaggtaataagaatgacaaaaccagtaaatcatgcaaaaattagttcctcgttgttgttaagaatttggctaccatatatcatgctagtttgtggattagattgcaatcaccagtagtagcatgttaaaatgtatatttcgtactagaaaagctataagaagtaattcaattatctaaatgccaaagtccaatttccatagcattttatgctgtatatttcgctatgccataaatgattttgtgctgtgcatgcaaagcatcagaaattcagaattgtatcatcatgctataatgtggaaaatgtaaaaaatgtaaattgccagctccttagaggcatgagcacaatacatgatactctaacctctggaagtgcttaggtggtgcatctagcaacatatcagctctatatttaaatgaaaaatagtttctaatcctttagtaataacaaaacccttcttccatggggtaatggcaagcaacagaatatggggcctgcatcaaaatatttgcatgcagtatcctttaaatgcatcccaaactgattgtatattccatttcttctctaatactacagaaggcatgacagcatacagaaagacaagcacaatcatcagtgattgtaaatgaaacatctgtgttgaaacttgtatatgaggtaatgtcattctgaacctaactttgcagacatcttagctagactcaaacttataacactgaaattcgtcagcaacacaaaaacctacagatctaaacaagattttcccaaataggccactgtatcaagcatagaagtgacatggatgtggcataacgagcgcttcaataaaaggttgatcaccattcactagtttcattgctgtgtgattcttttggatctttccttgtcaagtcctagaaagaatgccacatccagcggtacaatatttattttctcaccagatttacaaacctctttttgttgtgggaggagggcagtaagttgcctcaacaatattatatctattcatcagtactctccaatctatggaaattgtaatagcaacattaacatttttttttctattaaccatggtaatcttgggggagaagacctctacttaggcatcaagcagatctggtttctcaagcagagtcaatgtttcccacaaagcaaacctgttaaaaggattcctgctcatatgccatttaattatcttctgtacttcatttgctaaatctgaattccattccattttttgcgaataaaaaaagtacattgacaaaaccttttagccagagctggaggcagctctagaacatgcagaaaaactagttaataagcatacgagtggatgcaatcacttgcctgcatgactataggagcagcttcatgattgccattggcaaagcaaggtttgaggtattgtatgcgggcaggatgccagtccagcacctgcatcaaatgtaccatattatgcgatgttatgccagtgcttggcatgcaaaggcaccacagcatgccaagcactggcatgcatcagctttcatgccagcactggattccggtaaagcattgcaatctggcatgttatgcattgtcgcatatcaaccatgctaactagcattttcatccacagggcaaagcaccatatcaaatccttatttttggttatctcattcctcctatttttatctcctttatctctcttccaaagcatgttcatgacatggtgatcactaataagtgaaccaagctttgttatgccggtaccggtggccgttctggctagccggcggcacggtatgtggtacagccccgtaccgtatcataccggaccgacacgaaccgacgaatgcaaatcgaaccgggaggagaaaaagagagagaaatagagagagcgggggaagaaagaaaaggaaggaggaaaactcgtcggacacgtcgccggatagcctccggccggccatcggacggcgcactctgcatgtgcagtgccgcaagcatgaaacaagggggatgaataggggctgtcacccctattctgcggccgtggctccgcctacgcggtttccaccgcccggtggccacgatggttatccggcaaacgccggcggcccctccgccggctatcccctcccggtgagttctctctctttctcgctcttgtaaaagtcctatcagatgataaccaggccgtggaagcccttcagcaggccactgccggccttcggcggctagggtttttcctccctctcacttttcctctccttccctctccctcctccggtataccggtttcaccggccgaaccatcctgattccccaccggtctggctcggtacgagatgtaccgattggttcgggccggtatgaaattttttgagtagaacgcaatgtgcaatttaaaatttcttgagacatatttcatatcttaagttttcagcagtccatgctccatactacctgccacaacaatttttggactggaagcacagcattaccttttcctgtgcccgcatcaagaattccatatccaaatccaggctaaaaataccaagctatttgtcagaagggggaagtttcatatccactgaaataggatgtcagattattcatgcagacattagcatagccacgagataggtgttcaggaacaatctggataggggggaaagatttggaatacaaagaattttccaagaactcaggaagaagttcaataactaaaaaaaaaaggcaaagaatagccaccagcacatgcacatgggagacatttcatattcaaacttaaaggctagtatcactaatttatttctcaaaaaaaaaaagaaaaatgaaagaaaaagaacaaatgaaccagaggcaagaacaataaccaactgcctggaggactacaataccattgccagagcagaattatcaaaacttgtaatgcatgaagtgtttctaaaattagtcatcaaaaatttcacaatgaaacatgaaagtcatcagcaattaaatggatgcagatcatgcattacatgagtaaaaatttaagtaaccactcagccaagaattcatgacaatatgaataattcgaaacttttccaatgtttcaatgataagcactatgtggaaaagataaggtctgagcaagcaaagttccaaatgtaagaatgaacatgaaaaagtaaatggtacatttcacattgtgggctttaaatgtcaattagcacctctgtcttgtcagctacaccgatcagtcaagaaccatggcatgcattctcattttaacatatcaggcattccaaaatgtattccaaaatgttggacaggatacagcaaaataaccaattcagcacattaagatttaagaccctatcaaataaaatgaaaatactgcgttgaatgatttgattaaattatatacttaggtgatataggaatgctgaaatatgttcgtattccgaaatatgtggaccacataagaagagacatctaacaggcacatgcagtcttggtatcactatccagacatccaagagcgtgaacacagttacatcaagcatgttgaaatttccaggaatatttcttgacctttcatccgaacatatgcacccttacaatttagaaaggggtcatcatgctcctcgatcatgtcttcctacataatcagagttgtgattgcgctcttctttaggaagtaaaggcctatcactatcttattaaaactttttatgcaacacaaaacaaaattttgatgcactgcaacatgctcaggcaaggtacacggttgatgtccactacaagcagcaggtttatctagactttaattcagacaagaatacatggtttaatttcatagctaatccaggagatcatgatacacattcagactatctccaattaaaacctttctttgggaagaatcacattttgatcttcaacatcaatctaacaaaggttaaacataaagcaggcttcaagtttcatgtttaatttcaccgctcttgttacttataatgagtacaataaagcattcgaggtgacctaattgtccttttatggattcagaagttttgatcaattcgatcaggcgcttgccatctattttcattgttcaactgtttgacaaaatgaaaaaaccaaaagctctgccctccccaattcaaacaaaaagaatgcattgccaacaagtttcatggatgccatactgggtagatttggtgcaggtaatagcagaagtagcttctcccagttccagagttgttaagcactcaaacccctgtcatacttaaagcaccctaaccagcagatcttctcatgcaagacaactgagaaagaagttgacctctcaatttataataagataaatattacaagatatacataaggaatggaggagaaagaatttcatgtcatctcaaactgatataagaaagaagtgcatgatatcaacttaacattcaatttacatggaattaatgccacaacacgtaaatggaaaatacctcctgcacagtccaccttcttcagtacaatcaacctttcccaagagaatacgtccgtccatttcaggatcatatctggagatattcataaacaaaagttataaaaaaaaaagtcttccccgagaagcgataaacaacattcaatttaaacaagaaaggaataaaagaggatattaaacaatacctttctctcattatttttgcagtcctctcccatgatggtttctggagcaaattgtcaaatttcaaaaacccaaaattgaatgtgaatatggctcaaaatatttatttgccaacaacatttctctgacgattatcttataataaatattggtatttcggatattttataagataaatatgagcaattaatcaagagtctagttttataaaaaatttaagtatgaataacaatacagcctctaggagtctgggcatgcatctttggattgttgttgcatattcaactcctgttgcagctgctactgctattttcttgacctaccctattggtcaaggaagtttctctgatatgccttgaacaactgtattttaaatggattacaacatcctcgtgcatccatctcacatgttgggtggagccggtgaatatagcaacttcttattcagtgctatcaatggttccttggcaacctatactttgatcaaggaaaccactaaaaatgagtctactaatgaaggttacagattcagtcaagtagacgaaactcataatattgtaggtgcccatggtttatttggcagatttatctcacgatatgctagtttcaacaattcttgttccttaacatttatttttggctgcttggcttgcagtcggtatctagttacctgctttacgtatcagtactatgacttttaacctaaatggtttcaattccaaccaaactaatgtagacaatcagggttatgttattaccatctagactgatatcatcaatcatggtaagtttgatatggaagtaatgtatgaatgtaatgctcacaacttccctctagacatagcatcgaagttccatctataaatggataagaattttgtctgtgtacattgaagacaaagacatccactcctattcatttgtgctctaggaaacagaatgaacaagctgcatcaacatccatgcatatggaaagataagagacagtcaggcaacttcaaaaaatgcatattatgaatactgtcggcttctggctttttatggggatgaacatctgccattacttcattaaccactactagagggctttaactcaactggatggtgcttgttccctaattggagccaagaggatggctatgtaaaaaggtacatcaaaaagaccaggccccaacttgtaactgtaaatttacttcagcctttctacaaccaaaatcttcccatctccacacaagataatggtacagatggaagtgttccatgattataacagaaataccgagcaagaatcttctagctatggcaagacaccagctttgaaagcctgctccctgctcaagatcccctcccacttcaggcaactaagaagtaagagagatgaagtaaatgcagtaccttgtctaacagtgtgacacctagtttttgtcacatatgcaggccatgaagtgctactaatcaatggcaggcaggcagcataactaggaaccagatgcaaatgattaacatgcaggcctctttccatgcaattgcatggacagcctagccacaggatcagaagagatattttattttgaagagatgttcttggtgttctatctcctcaaatgacttgcaaatctggcaagttgctagaattgtgaagctgataacataactctagtgccgaatgtcttaaaccacactgaccattgtgttgctaccatcaccattgttgctcgatgaaggattggagatcagtataatggctcatacatgacattcagaatatgctagcatcaatttatctgccttctactaatttataataaatagtaagatttcactactaacaaacttgcaattgaaaaataaaatatatccacgttttgattgaaagaaaataaagatctcttcatatagagacaatcaagttgtaatattattttaaaaaaatggcagttttcgaaccatgtgaccaaggatcagagagattagttacctaatgtgttgccatataagagacctgcagcctctatgcatgaatcatcatgagatatactatagattgtggggtagggaagaggaaatgacaaagaatacgggaacgagcagcgaaggaaaagcattaaagggtcgtacacagggaagtttcgctgctcatcaggcacttaagggagcaaaaatgagagacagaacacacatgatcaaagtgttaagcatatatatatttttttaagttagcaatttgagttgtaaataaagttaaggtgaacatagtcgattattgacaaaagtaggatgcacacaggccaattttgacattgttcaggttgggccatcaggccaatgaaagaaaatctgggataaagttggacgagacatggagattttaaatgtccatccttttgccctccaaccaacagaacatacaagtgattcgaaaaccagtgaagcatgacttaaagtgaccaagatatactaaaatatacattacattaattttaggaaaatgatgactttttacaatttttagtgcagaacaagacatagaacgcttacaaaataatatataaccagtactgcataaggtcccagtcattcatgcatataagtctcttaaaaacttgctttcaccgtcacacatggtctcacaagtttggctgaatcaattgtttttaacaattaaaccccagaaatgatagcatagccagcttgccattatggaaaacattgatcaagtcagctgcatcagaagtgaacatggttctagtagtcaggcttgggacttctatatatcctataggccaggcttggccacatctaccatcttatgcacaatttggttttaaatcttgggatggtcctggacaagctctattccagccaaaactaaagaattgtcaggtcagtgaagaatttgatccatgttaagagatgaagttgctctcacagtgctgccatgtgcactcccaatggtaccatagcataaaggtatatcctgaaatttaaacttagtatatgtaccgcaacaataaaaatacaaacattaccaagcgattgctccagtagcaccaaggtgcataaaaattgaccaccaaaatgggatatctgaaaaacaaacgcttaaagtcaaatacaaaaagattgctcatgaaatgctgtaattaattataaaaagtctatgctcctacaatatttattagataaaatgtggcactgcacaagaattttggtatcataggcccacaaagtatcaaaatagaacacagacgaacaagtatttagattgtgcattacttcaactcaacaatatattcctcagagagcacaagcctcaagatgcatgaaatgcattcacctaataacaagggtatcaaccttgtgtatgtgtgtgtgtgtgtcattgattgatagatagcatgtgtgtgcacgtgcacatactagggcatcatccttgtgtgtgtggggatgtcttagatagatagatggatggataaatgcaatgggaaaaataagtttaactagtatctatgcaagttatgtattgatagatgtatgtagaaggaaaaggaagttcaactagaaccatgctattgcaattcaagctcaaatcttagtagtgcaaaaacaacattttgctaattaactgaacatctcacatgaccaatcaaaattggcaatatctaaaatgcctcaaaacaaaagggtaaaactgttcaaggttacttacctatgaatttaatggacccaacatggacaaggaaacaaggctagtgtgtccaaacatccattgcaccatacaaattaacaaaccatatcacatacacatcttttaaaaaaaccacataaaccaaaattcagtaggcttggatgcttataagccataaatcaaatcaaattattgtatctcatctcaaaatgacctcctgatgcctgagttagaagtacccaaaatattcggttttcacatttaagcatgaggaatttgtcattatctttgatgatatcaattttctaattgaatggctcatcaatgatttaatcaaattatatcaatttctctgtgtatatagatatagatagaatgcgttgtcatatgctcatgcttgttttgaatgtatgctgatgtttattttgaagcaagttgtcaaacatcaaggcatggaggcataccgtcaagaagttagtaggataagtgtcatactgcctacaataccagcacattgtacaagccaacacagtttgaaccggccaatatgcacctggtatggctcattttggcctccaaaattttccttttgttttttttttctttttttcaattttgaaggtctaaataaccagtttgcgcacaaatatggtaagtatagtcatttaaatttactaaagatcctagtagcagtgtgcgctaaagcttttctatcagtatttaactttcttttattaggtaattataatcttagataacccattatatggaacacattgaacaactatcttcatgcattaacaagagaataataattagttcgtattaaatcagtgaactaatgtataacactgaaaactgtcaagacagaagatgatagtgctagcattagtttgacaaatgaacaaagaatacattgaacatattattggacaaacaagaccatgttttgttaacatattccagactctaatgaaccaagctccaaaggaacaaatctcatagcaagaacctccccactgcctctcagtgcaattgccaccttcaaattgtgggaaacagggggggaaatctttaaaggaagtcttgcttgatattaaatggcaccaagcattccaagctttacataacacaatccatgccatttggacctgtttggccaaaaccaaggcataccaagcccctgtgcatcagcatccagctagcaaggggttggcctggtcagaattttaaaccaagattttaaatcccatgagatggggttgttccaattttcctatagaatgagatgtcttgttgatagatatgctaaatttacattagaagtatcaatatatgcgttaattaatccattttattgtgaatttgatacttcttttgttaattttccagtatcatcggttggaaagcccgaatccattatttgtgaaagatccgactcaaagactgaattcgagtccgagtatcagaacaagccaagagtaaatatgggagaggactcgtgtgaacacaatacaatatacagcacatacgacagacacgggcatgatgcgagcacggaagggcgctgcacacgtggaagacccaaatgaaagaaagaaaaaggatacatatggcattagcacaaatgaaaaaggttttggtgggcttcgacataagcattaaaaaggaggggccatgatacatttaaagcaatagaagagaaaaggtggctcgggcttcttcacgcatggagggagctgtatgcgggagtgaggtggcacggcaaggctctatgcgggcgctggaagcgattcatgcagaaatctgggcttttcagcttacagagctgagtggtttagcgcggtccacaagatgaaaaaaaagagagcggcttcgtgcgagagctggtctgtgagctgggcgtgtgcgggtgtgtacacgagcggttgggaagcaaggcagcctgatcatgcggaaaccaaaaaaaaaaagcacgagcaggtgatcaagcgacagcgcacgagattagaagaaaatttttttaaagaaaaaccctaacaccctctacccttcatcacgcttcctccgtgacttcgtctcaaccatccattatcttaaggtctctcacatcattagtcccacatggaaaaaatacaaaatcctcctctctacctacacctataagtaaagcccaatgcctctaccaagagacatctctctccacgttatagctcttgtagaggccttcatcccgtctttaggttctttagccaccttgtttccacttttttccatccttccaacatacgagaaggagagtcaactaggaggaggtgcgagaatcagaagggaagaaagttctgcagaagaagactgtgagagaaaatcctagtttaggtttttctttcttcctttgtttattttctgttttgaatctaactccaagcgctgttttgaactctgataagaagatctaaaggatattctatgagaaaccatgacaacggctatctaaatcattggtctagcagattcaaagaccctagatcttttagttaatatactactgcaattgtttctttcactacttcattagtagttacaagcaaattctttctgccttctttaaagctcgtctgagcaagaatttgaacacacttcaaacacccaatttctcgtgaaatcgacccatactcgccggaagtgctacattgcacaccgtgcacttgtagttacttttaagacacatcaagtttttgacaccattgccgaggatttgacgtgatttaatttgtattgtaaatttttgctcttcgtgcttttagtctttgttttagtctttcttttctgtcttccttatcttgcttacattaagttggtgagtgctggaagtcaggtacgcagtctaacctattcttttctttttgcatattacttagatcttatttgttattagtttttaattgaaacttgtttgatcttattggttgtgcataagcatatttaaaccactttaaaggcatgaacctaaataagataagatggagatttcattgtcctttcttggcccacaaataaattttctcatttgcattaaccctagcctttaagtaaaatcaattagatactaaccttagagacatccgagctcattaggacaaggaagcccaagagttggatcggattctaattaatcaattagttggtgtctaaggcaagtggttcggggattaaatcccgaagaacggtggttctctaattacgttcattacgaaaacacggggagcctcccaccaatcttacacttatctggccagttggttggttagttttaacttcaagtgctcaaaagcaaccttgacagttaggagctgtctagatttagactaaccctagttaggtttgattgtataacttgtttgttaaaaaaaaaaataacttctcatctatctcttcttcctcttctctcttctttaaattaaatcaaaaccagaaaaaaaaagaaaacaaagtgaaatagcgtccgactgaagatgttaaacttaacacttgttgggaggcaatccagttttttacacttaatttacttttttagtttgcttactttctttttaggacaggcagctaggctggagggagaaccagagcttcaagacccatactgaaccaagagcacattgagtcaggtatattcttttctgtccctttttgcaccctttatttttcttcctccatcaagaacaatgttgattaaattggggggtgtggtgaaaattattaaaaaatcctcgaataagttagtatttaacatttaggcatcaaattacgctcaagaatcgagctgaaccaaatatttttttgaaaataaaaaattgacgcatagatcagagagtttgtgagatactgaggaatcaagtattaagaaaatccaataaagagttaaatctagaacataaatattttttcttgaatatttctaattttttctaccaatatcagagaagaatttactttttatgggctagcatagggtaactatatgtttcttcataaaataaaaatcatctttaaaataaaataattttcaagtacttctcactgagtaaccggacctctttacctaagcaagcattgaatttcgcatcaaaaagtgcgaaaagcaaagaaactctgctgtaaagctagttttaactcgtagtctggttgattcgagctagtaagtccgaggggtattttatacctgtgccctagagccatctgatttgaaagtcattaactgaaaattcgctacatagatcagacaaaaagcttaaaggttaagacactcaatagtagtacaatgttaaagaaatatttaaaaaaatcaataaatgaaggacggaagtaataccacacatgcccatataaaagttagacgatttagagataaaagtagggataattttataaaaaaagatttaatgttcttggcttaacttccacattgattagtactaataccccaatgacatagctcactcccactctactgaacatcaatggtccttttgaaatttatctagtgaaactcgaaattttaagctaaacgatacttaggcataaatcctttctttactcgaggacgagtaaagtttaagttggagggtgtgatagatatgctaaatttacattagaagtatcaatatttacattaattaatctattttattgtaaacttgatagttctcttgttaattttcaagtatcattggttggaaagctcgaatccattatttgtaaaagattcgattcgaaaactgagtccgagttcgagtttcaggacaagtcaagagtaaatatggaagaaaactcatgtgaatgtggcacgatatacgacacgtaggacaaatacgggcatgacgcaagcacagaaggatgctgcacacgtggaagacccaaatgaaagaaagaaagaggatacatacggcattagcacaaataagaaagattttggtgggctttgacataagcattaaaaaggaggagcccatgatgcatttaaagcaatagaagagaaaaggtggcttgggcttcttcacgcgtggagggagccgtatgcaggaggtggcacggcaaggctctatgcgggtgctggaagcgattcatccgaaaatatgggcttttgggcttacagagctgagcggcttagcacagtccacaagatgaaaaaaaaagagagtggcttcatgcgggagctggtctgtgagctgggcatgtgtgggtgtacgcgagcggctgagaagtgaggcagcctgatcatgcggaaacaaaaaaaagcacgagcaggtgatcaagcggcagcgcgtgagattagaaggaaatatttttaaagagaaatcctaacaccctctacccttcatcatgcttcctccatgacttcatctcaaccatccattatcttaaggtctctcacatcattagtcccacatggaaaaaatacaaaattctcctctctgcctacatctataaataaagcccaatgcctctaccaagaaacatctctttctctacgccatagctcttgtagaagccttcatcccacctttagattctttatccaccttgttctcattttcttacacctttccaacacacgagaaagagagtcagccaaggggagatgcgagaatcaaaaggagagaaagttctgcagaggaaggccgtgagagattcaagtttaggattttctttcttcctttgtatattttttgttttgaatctaactccaagctctgttaatggcttaggagttaggaatatattgtagttacaaagtttaaattctaacaataaaattctattttaatattcatttaattatcgcttatgcaagttaaattctgcaagtttaatttcagcacataggatagtttactttatcttgctcttttccttcttatttaatttctgcatacctttaattttctgcaactttaaattccagcaaatagtgtaaggtttctttcatgttttttaatcgattttataacttttaaacgtatcatgtctggttaaataattcctctaggattagcgatgaagctagactatggttagaagccaattttctttggatttcttttcgtgcttttgatgtttagagtcctcctttccttccctcttgccaaaagacttgatgaattatagttggattgaaaccccttcataattcatgtttgattcgacgcaagaagtaataataggtagaagttcatgatttctacaaatcctcttcttctttctcttgtggaaaagcttgataagttatagttggattagagccccttcatagcacatatttgggtaacacaagagaagaagtaaagggagatcaaagtccacaacccttttttgctgtaaaatcttgataggtcatagttaggttaaaaattccttcatggcctatgcttggattaacataagaaaggaaagtctcttatctaagataaagcgaaatgcttgatggatcataattcagttaagtctcttcatgtccatgcttgttcatgctttgcactctgataagaagacctaaaggatattctatgagaaaccatgagaacggctatctaaatcattggtctagcagattcaaaaactctagatcctttatttaatatactactgcaattgtttctttcactgcttcattagttacaaacaaattcttcatcttttttaaagctcgtctgagcaagaatttgaacacacttcaaacacccaattccccatggaatcgatccgtactcaccggaagtgctacattgcataccatgcgtttgcggttacttttaaaatatatcaccagtcgtcccaccccgccctgacacttggaacaaaagatgccccaagacattctaatcaggatgctgggacactgatgggatggccctatcttaatacatgggatagtatcctatcccaatatcctatcggacatcccgttgggatctgaatccttaatttaaaccatgatttgaatgtgatatatcgcatgacttttgagctgatatttgaatcaattaggcttggtgtggttgtgtgcagatttaatgcatttcacaatcattatgccaagataacactagcttatgactagaaacacttggtaatcaccatgcttttctttcttaagccatcatcatgcttctgagaaaaatttactcaaccttttaggatactacatgtcaatcttcaaagcctccagacaatgtttatgctagcaaaaaaatattaagagatgctatatgtgttggtaagaactgagcaacaatcctatctgaggttcctcagaccaaccttagctgctcggtacgaggcataccatagcaacctcttttcacatgtatggtaaacaacagctcaatacagtgctctattgatacatggtacagttgctgtcctgtcttcagcaacataccatgtgccaatacagtagtgtactgttcagatccgcttacaggacgaagtccagtgaaactgaaaacctcgatcttatccatatcatccgagctcaagccttacttataactagagcgcacagcacatctccacaaacacttttgcaaaacaataaaccagcttcattttttttcttttttttggatagaatggaaagatcataccactctagtatgaatacatcctacaaaatcagaaaataaatatcatgaaacagagaaggaacaatccaaaatcagtcagcaacccagacctttatacaagaaattaagttaatacaattctgactaaatgcataaagagagattcttccatattttaaccaaaattggttgataggcttattgcaaagacaccatattagcttgcatcatatagatggcctatcacttcaattatctataataacactagacaattagctgcatctttgacaacaattcagatgtaaactagcaaatgcaaaatcctacagaggaatttgacattcaaatcaagaaatacacgatgtcacgcagccacaccaaagaagaattatgatgaaattaataaactatggtatcacaggaaccatgcattaatatcaagtgctaaagtcgtctacttactgacgtgcaaatttttcaaaattgtcagcagttaaagaaactgaaccatcagcatattcttcttcaatatcatctccatgtctattaatttttgggacgggtcctgggtggaattcagatcctgttgctattaaatttgggtctatcgaaaatctgcggacagtttttgtaatattcaacctgctctgcaaatcattgaatatgaactcaagttaaactagaagaatgaatagcccacataaaaccaattagcatccacatttggtaacaaaaaataaataactgtttgggaaaaaccattttacagatgaaactcatgaaagaatagaagtgcagaattctactttactttcttacggtaggcagatatttacttatttttcttggaaaaaacatcaacatacaatttagaagcaggactaatgaatgctaaattgatggttgctaaagaatttcctcccctttttgcagtatttcaaatataatcacaaaaaattagattctgcacagtctcaaacaatttcagataattgtgatgacaatgtcttgccttccaagaaatctttcatgtccttccaacaaaatgcaattttagtaaagcagcatataaatcaagccaaatatataattgatatagatcatttatacatcagcaccataattgacttatcatatcaaaacaaaacaacaaaaaattgcaagagacagacatgcatgcaacacatgtgcatgattgatcaagtctcgtactattgctatatttcatagccaatagccatcatccagtatatgctagcaatagcaagttccttaacttacctcgatagaatttattcaatgaataaaaaaggcaggcacccatgtataggcatgcaacaatgcaccaaatggatgcaagatccaataaatttgtctatgactgcaatgttaatttggttgtattcagtaaggttgctccactatgacccggtttgaaagaaggaaacagcctatcggcatgctgggggaaggttgcgtacatctaaaccttccctgatcttgcaatggcaagagccctatgccctggctgctctttttttatgttaatatggttgcattcagttctcactggcataatagaaggtttccataagtacagaagtttcaatattaaaagccatcagcaattcaacaatatatagttacatgcaaaggataatccagattatttgcttaacatgagtttgagtacacgttacatgactaatgcaattaacatcattggtgtttgatatgctgaagctgccactgcatcagttgatccaacattatatgatcaaaaagctcaacatggagcatcctactccaacaatattcagcaggtgaatagaaagaacataaatgcacatttctgtccagatatattctttcactggttattgatgccatgaaaagttaaactgagatgcaaactgaccccttgggaacatcttctaacaattttttaccataattaaccaaactaaggaccattttgtatggcagcaaaagacaatggaaacactgctcttctctgctgaccaacaaacccaatccagatctaccatatgcatgccacttgaatgaccaatcatcatctgattttatcatatagaatggaagaaatggcatttaatcagaccacatatgcacctcggtgtgcattgtagtcatactaaatacacagttgtgtacatgtttccatgcatatacttgcaaatgtatatggacatatatacaagcatacaattcttatatatatacatacatatatctatgtataattaaatttttatatttatttacatacatatgtatgtgcatgtatgtaaacacatacacacaagcacgcatgctcgcacacacaaaaaagagcatctttacctaagttatataattgtggctaaataaaagacatttctagtaaggtataatgctatgatataagcaaggaaaaagggagaagcaacaatatataacaaagaatatccacttactgttcccaacacatcgctcacatcaaccgatgcaaattcgcatgagagggcaggaaaactacaaaataagttttactgagtaagatatgtgcacaaaatgctgaaaactcaaagaactgaatgactttctttacacaacacaaaacaaaagatggttttaccttatgttaaaatcaatgcgtaagaactctgcatctgtacttttgtcaacaattataaatgtagaagtgctcactgtcaggtaagaattcaactcctgaaaaacaaaaacccagtccaccattctggaaattattaacttcataactaccaattaaacttaaacttttcttttggaaataactgaaccttacaagatttttgtgatgaatattatgaatacattgatcatgaagatggtggttgatgctggagtagattaacacatgaaaagtgtgatgaggaaaaaataaaggacttttgcatgtaaccacctaacagactgcaattaaaactagacctcagaaagtccagcaatttgcagaacaaaacctaacatttatatcacatcaaagaaatgaaatatttaattgatattcttccagcaatatctccatttaaatttctaaattactgttcctcccttatatgatttctttatccaacttcacatctactcaaccattgagagcccctataacaatgaggaagaggcatcagagccattttcaccttggtagtcaacttgataaagaagacttaaaataagcttttctttttttcttaaacaaacagtccaattgataggaggttccagtcagtatttaattatcaaaaagcacaatattaaattgcaatgttgagagtttatatgtaacagtattcagagaaatggaagcgttaagaagtgaaaaatgtttccatagatcagctaattgatttattcatgaatttcctagtattcacaaatcgatacactatattgatcatattattatcttataagacaaagtaagaagagaagaaaagcacccaccattccaaataaaaacatcatggaaaatgctgccatgatggataatccagcacctgaaagtgatgcctctgtcaagtctctaggtattttcctgtgctcaaaaaaggtgttaggtgctatacattcaatagcagcactagcagttgccctttaagggaagaaatttacttgaacagacaaaacaattgacaaggaaatcacaaaatttagtatcaacaatattcacattataataacctcagcatcaaacatcagttatttctttgtagtatactaaatttatccatatacaaaattataaatataaacataatgtcttctttcccaagcatgtatgtaaaattattgcaaacatcaaagaaaagaatttaagtattggtccatatgttaccatgctattaattgtacactagcacactactgcttgccatatattccattgacctaacttttttctttccttttatttttccataattttaattcattttcttgcatttttattcatttttttaatcaagactgctgaacgtggagttgagaccggcaactttgaagctcatttagttcaggcaagaccaaactgaaaactgagtttcaaacttcaagccaactttaagtcaatttattcacattgactgtcagagaatggtatcagatctctattcaatggaagtccaataaatttaaattgaagatgactttaaattggtgtcacacagacccttggtgcaagtgtcaaacatcttagtataccaaatgaacaacactttgacttccaaaaatcgtggcatggagatagttccctacaacataatttatcaaactatgacatataaataagtcaagagacatttactactagcataaataggcaagttattagcacttctgatgatatcagaattgccagcacttagtaactttaaaaaattaagatccaagtaatgcagcttttttatgaatcaagttgtattggtatatgttaaaatattcctattaggtaacaaggagtcatgtaacttgcatcttccaattttttaagctataaaaaacaaataatttcaagctttaagtagtaaacttccaatactaactttttatgtaggttgcccccctgacaataaattattgtcttctatttttacttttttttttggaagtaactcatgttggatataaaggaagaaagatgttagagctgattagcaaagctggccaatatatattacaaatggtaaatacatataataacactatgtgaacatgtgcgcgcacacacacacacacatatgtatacatattttttatatgatgtcactcaatctgttcttttatgctgggcattaacatgagtcatgtgtatagatcttgtaaataaatgcaaattattgcagcatcatccataaaggatgcatattctatatgcagataaatattagtcctgtgccctagtcagaagtgcattcattccagcatgtgctctcccaggttatggcatttgagctccaaacaaaaggatctaaagcattcaaagctttagagaaatatcaataaagaatcttgttgtgcatgacaaatctccgatgtgactaaattaccaccatgaggcagctgtggctaaatttttgttgccaccactattcgcatgccttgctcaataaactacaattagtaaactgcagtttgttgctttatccatgatcatcataaaggctgaattacataaagagaacttgtgtagccctcttgtagctttcaaataaacttatacaccaataaagtccttactagattatagttccaattctaaggtaagctacaaggttttccactgaagcttggacccaattcaaccccttgcttgcctcttttaggcctcttctgccctccaaatttccaatttgaggtgtatttagacatcagggtcaaaattgtgtgaaatcaatcaacatcttacatatgaacacgatttgggcatagcccaacttgtcttctcaaaaaagatgcaacattattgttcagcaatagttgtttctcttacaaccctatgaccttggtattgttgccaaacatcgccatgaatacatgtctgttcatagagattgttctctctttttcccatatggaaagagcaagtaagcccaacaagttactttatgaaatcaattattgtctccacactatcagcatagcatggcccacaactttgagtcacttatagctccaacctgatattggtttcctcagcctaagtgcacacttgcaggcctcaagaaccgacagcttgcctatgctttccaatttgctccaacccttatgacccacttgccaagctagctttccctcatgatgcataatcatgcctacatccagctcttacccccattccccctccacccaactctctctctctctctctttctgtccacgcacgtgcgtgtgcatgtgtgtgggagcaccagcacacatgcatgcaaggtcattacaatatgataaggcaaggtccaaggcaattcctcatccaagatttttaacctggcccatcaaagtttgatgtcagacttaagctgatgcaagcctagatatacgtggtgggaatttggttttcctattttcatctcatgcaaaattattcatggcactaatagcgcgagattaaaacattccaagggaaaaaggtagaacgaaaaagataaacctaaacgcactacagaaagccaatataaaactggaataagcacttgcactgcagagccgttaattacctttcacaacacaaaatgctcatacaagaaaataaataaataaaaatacaaagagtaggccttattccatctctttgctttcaacatgatgaatcctgcttcaccactcattattctaaacccttttccccacttccacaaaccctacaaagtgatgttgtctatggcaaacttcgtgcggggccagacaatatcaagaaatcagtaaaacccgcagcattagcaccgtacagccctccaaatctccattacattcttcatctaaataaatacatttgtttcagtctccatgctattcaaatccagagaatccaaacccaaaaagaacagttgccaatcgtcaagaaaacaagattctttaggaacgatcaagaaaacagcattgacgccaaattctaacggaagaagaactaaaaaatatttaaagaatcacatgatcaagaaaatcccgacaagaatcgccacttttcaccgattcgtcgggaaccgaggaagcgtgggaatcttgactgagattcggaaagggatcggagatctgacctgtagaaatcgaccgatttgagcttgctggcggagatcatggcttccggcgagagaatgagagagacgatccgtggctccaccctaagccgacgacggtttctgaatccaagaagtaggaaggcgagagagatgttttcggctctctctgtcttcgagcctcgtacgctgccctggccgtttgcgtccagaagcacgcgcctttccgcttatataaaataactaattaattaattaattaaaattacattttgactccccactatttttttaatgttttacgtacgtctattaacaaccaaatctcaaattttaaaattatttttattacaatacgattcaactatctacctctattaataaaatataaaaatattatatcatataactattatataataatttaaaattaatttaaaattaaaaatattttagagtttaaaataatttatacaattctactctatcttgaaagtcactcttctcctctctctctctcttttttaccaccactactttatatcggatacaatatctagatgtaacgggataggaagagaataaagaaactagaacaaatctatcatgacttcatccctcttttttccctccatgcaccttacttagttaaatccatcttcaacatcctccccaccatcattctcaatactcaacctcgatgctaattcatcaaattatcaattttgcaacaccgatgcttgttcatcaaactagcaattttgcaacattagcaccactatcatcggtggatggggttgggttgccggactagatgtctgatcctaacaaatctaggacttccaaaaaaattcaaacaccaacagccattttactaacttgtcaaattatcaggtagaatataattacatggcttgtcatcaaatttgcagtgcttcacatcttgtccgaactaattgtattgacatatccatagaatgttcctaattaagtaagcttctattttcaggttttggtatcccaactcctctcacaagattcaaataatagatgctggactcgagtggtcacctactaaaaaccaatatagacgaaagtgattgcatgccaagcaaagaactagctaatgcatatggtatttgagaaagaccaaggagcaaaattatggagctaaccttcaattcaatatccataattgtcatcattgagtgcgccagcagaacacttctcaagaaataaggtacatacccgagcatttcaactaaatgctaccattcaattatcttacgttgatattcccttttagtattttccaatgcaccaccccataaagatagatgcggcaatatcttggacaataattcctacaatatttacatcaaaaaggttcgatgcaattcaatttcaccctaggttcgaaacgatttagtagactccatcttcttcctctaatgtgaatcttgtatattttggccatccaatctcaaacctatcctagtctatcctggcccctattccacttgtcacttgtcattgacagttcttatttccttattcctctctatcgtgtcctcacattttccactgaaaccttggccagctcataaatttctcttccaacgaagtccatgagttctcatgcatatccatctcttttcataaaaacaaagaatccgacggccgacggaaggctgtcgatctccatatccttcttctgaacctccttcccaggcccattgatcgtcacattgagctgtgactccttgatggcaatctcaccattcctctgctccaccgactcctctacttcatgagctcctcaacattaatcttattggcatggagtgcttctgagacttcgggaggccatggcgaacctcccaggccttccccatcagtgtccttgtgggaaagtgttaccaacattgacaactaagaaagaaatatgggagattttcttggtttggaaccctgcaacaacgctggaagtagacttagaaatctcacggatttggggagtgcggtgggaccgtgtaaagatacggctgagagcatttgattatttttttttttaaagtcatttttatctcataggacccaatcagcagcgtatccgtctattttcacttttccttttgtatttctattttttcttttgctgcaatgataaaaatttttcaacccgacaagtcttcaaagttaaatggttccaagaacagttttccacttgtgaaaacaaatcaaacatttaatagattactacgtacttggcacttatatctatttagctatatatcttatttctgaaaataaaaaaaatctcccatcttgtttagaaagtggacggatgctcgaaaaatattttgatatagcttgaacgtgaaattgtcttgcaagtaaagaaggcaatatgtcgagtaatgctaaccagtctcacttcactccctatttggtgcatcaatgttacatgatgataggagattggtgcaaaataaagaggtatatacatggtgtcccacttacaatagagctaattatcgaaccaagtactaagatcttgcaattgaggaaatcgggtgcacaatgcgcttgcatgtgttggattaatcccgcttgcaaggcaaccaattaataagaccctacaatcaaaaaaatcagatgcaacttgcacatatttagtcacgatacaatggtttcttgccaaggattttattggcccatatgtgcaaaagcttcgttgcattatgtagtttttattagttttattcaaatattctctttatctactttttataattgatttgagataaatatagtcaaatattttatgtatatttggtgattaattgtgttttttggaggaacaattctgaaaaggagagcccgagtaatggcatggaacaagcaaatgtagggtagcacattttcacaaaactatttaaatgaagtcataactcaaccaagacacgtaaatatgaagggaaatgaacttttttagggagttacaaggccctaacaatattaaaataagaaagatgttacctttctgttcaccactcaatcatcctccaggtaagctaggttttgacacaagcctgaaggaggtaaacgagagaataccaataagagggctctcaatcaagagaaaccaatatagatgaacttctgtgaaaaaggttccggaaggatgccttttccgcttgccgatggagtcaccaatcctaggaaacaaaatccttttgggaacaaaggaagaactttgtagctcttcttgccttatgatgggataatcaaggaatacatgaacggaataaaaggaaaggagacaaagctaaggcatttggctgaatcaaaatattccaagctagtaagaaaaaaaagtaggtttttgggtgaaaccaaaacttctttaagggtgaaaaaatttaagcatgcagacatgggcaagtgtaattcatgctttcttagtaagttcctatagtgttccatcatctcaaaatgcttaaaagaattgacaatacttctaacaacctaggacctcatgagggctagccaaaaggtgttcataagattcattggccttatacaaagtatccaaaattcttatagcatagaaatttgtttgggtcctcatgtgatctcccaatttaaattttgaaactctcgacagacttaggatttaagtccaatcaaatttaatcacaaatattattggctcatggttagttcgaaaagaattaatgttgtagtatctctaggttatatggtttattgactagattcactctgaacatttgaaataaccaagaagcttacttaaaaaagctagctagaaggtattgctttgattccatagctttatataagtatcagaatttacctaatgcacaataaatatggcactaaatatatacatgcttagatcctcacatatgttcttatttacgccatacgcaactagcacctgtcttgcttctcataaaggagaaaactcaagagaagaaatcaagagaagaaataatgaaattttatttccgtcatgtcaaaaaaaaaaaaaaagtaggggagaggtggaccaaaataaataaattttaatgcttttttcatgaccaacatacccttgcacataagtttatgttataattagcctaaagccactaaaattacaatagaaaatagctaaagtattgaagtaacaaaatacaaagaaagtgatgaaaaattctaaattaattagctaaaccaactcaatttttgacttgctctaaaatttggctcgatctaagattcgacgcatcaattcgggctcttggttcaagcctcatttattcacaagtgtgtcagtgcccatcatcaatgtcgatagtaagtctaggatatcgattaatattttctatgttggttgtgtgaatctcgagactttataggaatgttgtgtgatgctggacacttttgatcttcttcttgcttgctttttttgattgcctatatagtttattatttcaacgtaatacagcatggtcttccaaacattttgctcaagtttcccctttttttttaatgcttgaggaccaaaatctggtttttcagaaaaatctcaatatcctaaattattggagaattgatactttataccaaaaccacctaataaatagtgcctatcctatgatcaattacaccaattctctcttggcacatatcatacctatcatgaaggcttttacttggtaaaaaataagactttgtgtatttggattttagaggtgacaatttactccactccatcggatagtcggaatgggttttactcaactcacagctgatctaggatagtacagataatagtaaaacttgcctgaaaattgatctagatatatttaactacttaaaaatctcatcccgaggccaaaaaaacaaaaaaataatgtattcaaaaatctccaccatgctatttaactctatccacctcacctcgccatgctttgccctaaggcaaatacaggataggtatggataatagctatccgattcatatctgatctattaccattcctataaatattactcttaaaaaaaaattatctcagccatctttgattgactgaaagtaggattttagaagaagacttttctcgaaagcaatcacttaaaatagtttggttgccttgaatgaccaccaagtaaattcttgtatgtttgtccaatttgataaatcatgactacaaattcatttttataatttcaaaaagggatcaaagtggtttgaagtgaggtagtttgatttttgccatttttatgcagttaaacatatcttaaaaatcaaatgtgacataatttttttaaaggactattttggaattgtttgaaaatagggactaatttgtccaaatccatatcttttttcccaatttctaattaatcatcgacttgatatggatcactttgatctctttgagtaggactaaacatgatctaaaagtaaactccatcatatcaagaagccaaatcataaatcaaactttcaaaaataataatttgatcatacgatacatgattgagatgatcttttttttttaaatgaaaatcttttcaagacctacaatatagcaccacctttcatagaaagccatgtatctagtgatcaggacaaaattctatcatttagatctcaaaatggatcggccaaatcaaaaactttttttttttgaaaaagagtttcgttggatgtatctttgaatcaagaaagaatcaagtagagttataggaggtaacgtggttataaaagtcgagatttacatcttataggatgtcaactttttcatatttatttttacaaatcatatctattttgaaaagccacatttattcaaactagaagagaaatccaatacaaattatataagaacagacatcattattataaataaagaatatgtacaacaaattttgaatatcaatgaaagaaaaaaaggacctaaaccctatttttgctaatttttccatctttttctatatattttttgagtgattcaagctaagtgggttgagaaaagttttcttctccctgattgaatcattaatcttctagaaaatccttctaaccttttccctgccttttcttgtttcctttgttagaacatttcttttattataattttttttgattacactattttcttctaggataactctcatatatatgagcaaaactttccagttgggcactagtttcctttccaaaaaaatttaaatttacataatcgatcatccatagtcactaaattcgtttggtctccatattaatacatagtttctatatctctattttacatatttgtagttttatttcttaccattttttaccttatatatagtatatatttcccatatattgcactctctatgttaatgacagccattatatctttgtttttagaaactagccattacttctatcattttctaatttggatcgtctatattgtcttttcatattagcatttaaatcaatctatttattcctaaactttccatattgatacttaggataaatgcccatttagaatcattttcatcttacatatttgtcattcttattttcttaccatatttgtattttatatatagtatatatttcccatataatatatgcactctctatgttaatgactgccattatatctctatttttagatactagccattacttccatcattttccaagttggatcttccatattttcttttcatattagcatttaaatctatccatttattcttgatccttccatattagcatgtaggatatatgcccatttattattgtcacattcttccctatatgcattcatttagaatcttacataacttatgaggatgctacaaaaagaggaaggtttagcaagattaatgactatatcttggatacaatgagtatatctatgacataatatttttataaattgataattattttcattattttccaaattggatctttgatattttctttttatattagcatttaaatctatccatttatttttaaactttccatattgacactttggatatatgtcaatttattattattgcattccttccccacaagcattcatttagaatcatacaaaactaatagaagatgactgcaaaatgaggaaggtttagctagatattaatgagtatatcctagttataatgagtacatccatgacataatatttctagaaactaattattatttctattcctgaacttttcatattgatactttggacatatgcccatttattattatcgcattccttccctatatgcattctttcagaatcatacacagctgatcgagaatggctgcaaaaagagaaaggtttagctagattaatgagcatatccgagttataatgagtatatctacatatcacttatccattcattaatcatacccactagtcctaagtgggctaatcgaagattggtgtgatactgtcatattccaaacccatcgttgacacatgacactctattggatgaataacaacttcacaatataaatctcatttttagaataataatttaactcaatactaataacaattctagctacatataaatagtaatacaatggtatcatatatgtttatttctttatctatctctcactaacagacccaacttctgctaaaagctaagactcttgaggctctaaaatgaaaaataaaaaactagtataagctcactaggttagtaaaaaaatccccatatgcgtagactaatatatgaatataactaatggaataatataaagcataataatcataatatgtaagtgccaaataatcgaattctgaataacactgaataagaaaacctgatatgcatcaatcatatgccaagaaatcaattttttctagtaatatttttagatggatattttatcattaaatttaaaaagttggattcagtaataatcccaaaatttcgcaataaggacttccaactacctttttgatattggattagccatgaccatgttctagactatgaccaataaatcaaagtgctacattcttgctcatagtgggactatccatagtgccatattcttatccatgataagctattcatattatcacattcttttctatgaagaggctatccataataccacatttctacctatgtctatctacaatgctatatttctactcatgagaaggctatgcacaattaacctgattagtcccaatatctctttctcaactattaagttattaaatcttactcatgctaagtaaaatataatttaatactatatttcttttcaattttcaaagcaaccaatatgatatcccaagaaaccaaaaatcatcaatatttgatgaatgtatacaataaagaaagtattataccaaaaatcatgtgttgaataacaatcatccatgcaaagccagaaaccatcgatacatgaaaggtaaatatataaacacctataaagatataggtgattgtatataaagatttttgcctaagccgatacaagtccaataatgcacctactgaagcaagcatatccttaataaattttaataaattagatatcaatatttattataattaagttatctagccatccaataaaagtaaacctaaaatttatctttgccccgatcttcactaattcaaatttattacctaacatcaatcaagtgagaggattagaatttttggctccatccaagggcttgagtacacaacccatgctagatggtttcttgtcccaacaattgttctcccactaatttgattcaataaattagggaataaataaattgtaagaaaggatatcactacaataaaaaagatctacaacaatggtcaaaatcgtggcaataaacatagcaaaccattagtaaaatttatatcactacttctatataaagattcgaagctaaaacttcttaaattattatctactgtgagttatcacgacaacattagcttttaatatgaagttatagcttattatacttattcatataataaaatatacttatttcaaatatattatgatactttatattttaataaatattttttataaaaaaattgattctcattttttgataaaaaataaaaaattattttattttattttattttttataatattttaaaaatattttatttaaaatatttaaaaatatagataattttaatatatttttataatcacactataacataacaggatattagtgatacaaaaaatttatcgttaataatagattttcatcggtaatagttattagctataaaattattatcgctaatatttagtcataaataatatcatcgttgataattttttatgataaaaaaaaattttatcatcaataattgatattatcgatcaaaaattttcatcgttaaaaattttttttcaaaaactatttaagataaaaaattttagtcataaaaaaaataatttatgacaaaatattacgtcactaataagtatttatgatgaatcatattcatcactattaatttaattaaaattttttataaaaattaaatttaaaaaatattaatgatgataaattttttatcataaatataataatttttgacataaatttttatcactaataaattatcaattatttatgataaaaatattattattattattaatttaatataaaattttaatatttttaaatttattaaaaaaattatttacaatcaatttttagttgctaatatattttttggtgaccaatctttcgttcgaaataattctgtcactaaaaatttacatatattttttaaaaataatttatgaatatatatatatataatttatatttataatattttataaattaaaattaaaattaaaattaaaaatttacacagtaaattcataaataaattttatcattttattatattaaattaaaataataagagatctaaaataaaaataaaaaactacataaaaaggccatcaagtattgacatctgtagaaggagaacgggctaggaaagaagagtgctcagaagagctcagaccaatctactacagtctcatcaactgcatcatctgctccatctatgctatccgctccatcaactggatttggagccgctggtactcattgacgcatgcagctaactcatcagctcgctgctcagcctgcctctacacctcttcagccgagcatcgcaggaagcatgggtgtcagccctagacgagagtgaggatgagggagcattgatcccataccctagacccctaacataataggatctcataccaagtacctaatcacagatctcgtcatctgtgggtgcgatcgagcccttaggggtaaattaggatctgatacctatcatacggtcttgaaaattaaacttatagctattttaattttatactaaaaatcaaactgtgaataaaaaaataattaaaaaaacttataaaaagctcctggctcttcatcgtttactctcctgaccatcgctggtggatccgctggtagatattgattctatcaggaagctcaccactctgcatctctctgcaatttgagatcaattatttaaaaaaattttaaatagttagagagttaaaatatactaattagaaattacttaccatctgcttcatatgacgaacatacgacctcgaaccctcacaatgcaatacggtttgtctcgcctgattcactgtgttctggacacatcgtctctgtaaagttagcagtcaaattagtagataacaaattaaatttaagaataaatgattcaattattaaactactaaaaaaaaagaagtttggatgtgtaacctgatttaccggatcctcgtaatgctggcatatgagagcccaatcatccatagtgatgctatcatagggctgctgctacgctgcctccaccccataatcctacatcacatggtgccaatgctgatagatgcggtggtcatattctttgaaacgcaaacataaatgagcgttcacagctcgctgcacgcgatccttctcaaaatcaataatatcaaatataccttgccaataacaaatattaaaagaacaccatgctaataaatattcacagtataatttattttacctataactggttgtaaaaaatctctctctaagtccgtacaatgtgacacctatcgaaaagcatcatggggatatagctgcggcatatgatacccagctcggtctgccacagctcgcactatcccctaataggcttggtgtagctggatggtatcttaatacgaagacactatcccgagtgctcgcatctccaatactctaaagagaggttcttcgatggacctcatcctcgcctcaccactggtggagactggtctgaaacaacaataaataaatcattagtatgatagctattcaaataaaaaaattaaattttattatataaaaagtataataatattactaggatccgcctcactcggatccgcctcattgggacctgccagtgcaggaccctctggcgacggagctggtgcggtagtaaaaatggatgaaggcgcctcagcctcaagggtagactgcgaatgcgaacgtcgtcgtctgtcttctgatgccatatctataattcttgacatataaataaatataatattaaataataatagtaaaaaataaattatattctaatgaatagaattatatcatataccaatattattgcaagagaagattgaataaagaatatagatctactcatcaatattcatatttttctcgatgtataggtcctccttcgaatcacaataatcgactaatgtatcatctcctatctcatcatcatttatgaattgatcatcgtcctttgactcatcaagattaaatataaaatcagcttcaacttcgttggatagcaaatcagtcatattcaaaggagttattacaagttcttcatcaacaaaaagctcggctaatgtttgttctttctcttgaaaagcttcttcttcatgtaaattcgaattttcattcatctctagtcgggttggtatgtcatatatgcctctaagtattattttttgtataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatactcccaactcaatcaatacagtttgaatatcaccacccaaatagccacgcatgaccacaagaagcaagcattgtatcatcacatggaagtcatgacttttcatgccagagatattgccatcgttgttaccaacacaccgcgatatatttgaagcgtatgtgtcagaaaattttatagttttgaaccatccacagaaactcttttttttctcgtcaaacagcaaataacatgtagatggcataaaaaatctatcacctcgatgaactaaatgcaacttcgatcggattcttattttctgtaaatcaagacgagtttttgtactatcttttattttttctgagatatttaatactgtaccgatgatattacataaatattcttctcaatgtgcattacatctagattttgacgaagtagtagctgcttccaatacggtagttcaaaaaaaatacttcattttgtccaattcagctcaacttcattacgctttcacttgcgagtactcaatatttttttcaaattagatgttttcaatgatttcaagttgttctaaaacttctgttccacttaacttcttaggtggtagacgttgattggacttatcatcaaagaattgattgtaacggatcctccaagaatgattatcaagtagaaatcatcgatgaactacgaagcatatttttcgtccatactttaaatgtaaggaggatgcatcttcgttgcatattggatatgccagatatcctttggtgctccacccaaataagttttcatatgcaaaaaaattatttatgatctataaaattgaagcatgcaacttaaaattttttcgactcataaaatcatatatacgtactctattttttcatagctctttcagatcatcgattaacgattgtagatatacatcaatttcattacttggtgctttcgaatctggaatcaacagtgacataaaaataaatgattctttcatgtacttccaagatgacacattatatacaactagcatcacagaccatatgctgtaggaagtactcaaattgccaaagagattaaatccatttgtcgctagatcaagtcggatattacgtgggtcactcgcaaagtgtagatgctttgcatcgaaatctttctacactacagagacgatcagatggctaagtatgttctctttcagaacctgctactcatgatgtcatctcatttcttcagctatctttatggacatatacaatctttgaagtcttggaatcaatgaaaaatatctcaaaatcttttgaggtatcttctttccttttctattattgattttatacctaagatcactgtattttagatatttgttgcctgtttattatccttataaaataatatacagtcatttttgcaggcatatataagaatatagctaagtttcaatttccgcatgtatatttttgcttcagaatacgattttgaaagtctctctccatcaggaagaactgctttaatcaatgtcaaatgacttctgactccatcggttcatgattttaatatgaaataattttatcaaaaactctaacttagagaactttgcacaatttggatagagtggctctcgtgcatcccttacaagatttgcaaactgttcagaagtttcttctatcttaagctggatattatgtttataatcagaattgcctttagatggactagtactaatgcatacatttaaacaaatattctgatgtaaatcatccaatagttcttctataccaccatgttcgacagattcagcagcatcactatcatcttcagtatcgtcatcattacgcacaacttcattcagatcaccccccatgtcatattcagcaaatatacttcttatccataccataacatagcagattctcctctacaagtattatgtgatgatataccatattgacacatcttttgcacggatattttatctgactagcactgtcagccttatgccgtacaaactctataaaatctcaaacaccttttcgatattcaggtaaaaaaatatctctagcattcattcaatttttgttgatatccatttagcaacaaacacaaaaatcattataaacaaagaaatttttagtggtataaccaaatattgatccagatttcagatcgaatttcgatcggatttcggaccgaatttcaatcgaatttcggaccaaatcctgatctaaatctaaacacagattattttatacaaaacagtacgtattaaataatacagactgaacagtaacacaaaaaatctccttccactaatttaatgaagcaaaaatatatgaatctatctatttcaaatcattactaacaggtgtggccctatcttttttaaaaaataataattttattattattagtcgatattttatttcattattgtaaaaatttcgatagcatcttcccatggttcttcaaatatacgacgtgaatatggtgcctgcgcaccctatctactatatacctggagaatagtagacagataacagttgagtaccacagaatgaaacaaaatatcaactattaacaataataagattattatttttttaaaaaatttgaatacgggacatccaagagtcgatctcaatcaagaataatttttaaacgaaaatctacggctcaatgcaatttaactaccatctctgaacatatattcaaagatggatttttaatttatcaaaaaagagtaactctacattgaaattttttcatcaaaaattttagtaaattttttttaaaataaaaatattttttatatttaattataataagcaaaagcatacaaaataacatataaaataattaaattgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcaccccggccgcccaccccagcaacccccttcacccctcgaaccccaacccacgtgtcacccccggccgcccacccccaaccccataaccccctctgccccccggtggcccgatcaatcaaaaaaaaaaggatggaaagaacccttacctccagtggatagcaaaggcgacgttggagaagcccacggcaacggtgcggacggcaatggcggcggtgatgatggagacgcgctcgctggcgggaagagaggggggagagctcgaagaggaagaggggagagggagagctcgatcggagaggggagaggagagagctcaaagaggggagagaggagagggaggggggaagaagagggtttcacgcgaaggaacgttgagttgatgtctaattaatgcagaactattagcgatgaaaattttcattactaataccattattagcgatgaaaaattatttttatcattaataatttccatcaaaaaaaaattttaccaaaaaaatttttttctctaaaaaaatttcgtccaaaaataaattattgacgatggattaaaaaattttcatcattaataagtctattagcgactaaaatctagtttctgtcactaataaatatcgctcaaaaaaaatttctctctaacaaatttttcttcaaaaaaatttaaaaaaaattattttttaaatactttttctaatgaaaatatcttttcatcactaataaattatttttctattaacaaattttttattcataaaaattaattaaaataatatttttaaaatatggttgctgatgaaatataaatttatataccaaatatattttcataaaaaaattataaaaaaatttaaaggctatttgcgataaaaatttatttttatcactaataattaagtatttttcaataataatttcattaaaaaataattttggattttttccaccaagaaaatttttatccaaaaaatttaataaaaaatgatattaaaaaatattcatgatgaaaaataaaattaattttctttaatctaaaattttttttggtctaaaaaaaattttttcaaaataatttcattaaaaaaaaataattttttattaatcaaaaaaattttgctccaataaaagtttttttcttcaaaaaaaaattacgtacaaaaaaaaatataattgtgacaaaaagttcaattaatattgctaataatttttataattaagaatagctcttcagcttctgtaatagaattggcactatagaagatcgatagttttgatatcttcgatcttcaaagagctcatctgattttcttagagtcttcgttctagaagttgaagtatgaaaatatcacgatgattttgagatcgtgagagaaatccatcaagatttagatttgaaggatatgatagggatagaaagttagaggtccagaagcttgtatattgcatgtatgtgaggattgagcttgagaaattaaaaaaaattgtatgagagtatcaaagatctagcaattaatcaaaatcaaagcagatctatggatagtgtaagttatattataaagtacaagctcatatttatgctttgtattgctagaaagatgagtgcttgtattatttgttttctcatgattgaaactcttacagagatacatttaaatgtccatcgatacagaaagtacggtacctttcgagatcgtgaaagtcatgctaaaatatactatttaactatatgatttctgcatgaaaagaggcttcttttatgcagcttaaggcagacactccatctgaaagattcattgatatcactacaaaaaataaatacagttgccttacacaaaatcaagaatttaaattttataatttttaatttttaattttttacatattgacgataaaaatattttcatcgtaaataaaagtatttacgatgaaaataaaatttttatcataaatacttaattatttaagataaaaaattttcatcacaaataataagcaacttttgatttttttaaattattaatttttttaaaaatattgatgataataatatttttatcataaataatcgagtatttatgatgaatattttttttcttcatcaaaattatttatttatattgaaaaatttttatcataaataatgaataatttttgattttttgattttttatttttttaactattgacgataaaaatattttcattataaataatcaagtatttatgataaaaaaaaaatttcattataaaaaagtatttatttatgatgaaaaatttttatcataaataatgagtaatttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcattataaaaagtatttatttatgatgaaaaatttttatcataaataatgagtaatttttatttttttttttaaatttttaattttttaactatttacgatgaaaatattttcatcgtaaataatcacgtatttatgatagaaaattttttcatttcaaatattcaattatttataatgaaatattttcatcataaataatctataatttttaaattttttaaattttttattttttttcaaatattggcgacaataaattttatgttggaaataatattagtttcaatagaaaaatattttctatcataaatacttaaataatttataaaaaaaatattttaatcataaatatttaaaaatttaaaattaaaataaatgatgtattatttaagataaaaatattcatcgtaaataataaatatttacgatggaataattttttcgttgctgataggtaactatttgcgatgaaattattttcgttgtaaatattttattatttatgatcaattttttttatcataaatatggttagtggcgatgaaatatttgtattgcaaataattccatcgcaaaaatgctctagtatcattttttttaatgatttttaaagaatagataatttataattcttttattcaccttgtaattaaaacataataatatttaatattgaatatttttaatattttatattatttattttatttaagtagttttaatttttttatatatattttaatataaattaggtcgaatcagcaatctaaatccttggttaagtcagcctttatgcaaatttttaataattatatcttacatcgttatctagttacggtgttccatttacaatattgataataaattttgtaccgataactatatatatttaattgttagactaatttgacttatgtaatttatttattaaatggatcagatcaaatcaaattgaaaataacacatttaacccatcaaaaaattatagataaaaatataatatatttttttgaagataaaggaggccaaaagagccacccaaggtttttattccatgaaaacaatttacagctgaatatgtagaatagattaatacaagggcttcctagagtgctgtctcaatttgatatgcaaccatttgaaggggatccaaccaatagcgaggataactattccagatatatagcattatactgaaagggacaagtcaccaagcagctgaagacacagggaggaaataccacaactggagccacagagcgtaacatttcacagcacagtagattggcagttctatggtcatacataacatatgctttgatgccgagcagcactggaggactgtgcccaacaagacggggccgtaaagggttacttatgcccattaaagcaacatgacatcccaaccaactggttgttttccttgctgtgttgccacaactagcacagcaaccccactgcactccccccatccccacccccccgacacacaaaaagtattgctgataccattaatgtggattggactatacgtgatgattaaactaaattaatcaatatccttctcttattttcggtcaaggttccttgacatagcttgtttgtcgacagatacagctctcccaccaaatctgtggcaagttatatttgtccaaacttcgatcacatgtttttccatcacaaagttgtccttttcttttcttcttgaactcatgttgcgataccatttcaaagttccagcagttgaaatccaaggtatcttcttattgacttcaatagtggaacagaaccaaaatgttgacgatcgaagttttaagaaaagaagttaattttaccatactttaagcaggaaattcagcataataatgacacacatttaggtgttggaatgggattctttgacgcccaaaactaatattcgagaatggtggtggtccaatttgcatagatttgaacggcaatgcatatattttgtaaatgacttacatttacttattagttgaatattgcaatatggctggcactaaatcattaagtgattcttcatgcagcagactagcgacatgccaactaccgggaaatagacaaaaacactttcaatgttttgcaaggcgatgatttattatttagattctattcgatcagtcctccataagtaaataatatcctcaggtttacgagcaaataaaacccacatctgatggctttagcatggattgcatcggtttagataccatatgagtggctaaaagcccagacagaatattcatttttttgccagaaaaagaaaacctgaaaacttttacatgtagaaaaccttattttgagcaaaactatggtaactcactggttcatattgaaatattctagtgcaaaagaatatgcatctccccactaaccattacgaagaaatctgcagttaccgtaataatacctcggaaatttacataggcagttcactcttgtgatttgagattttggttctcagacctttttaggaggaaatgattctctaacatttgaatttgagtaatgagtttttaatgtagataatcgatgacacttagaaagtattcatattacacatgtagattttttggttttttctggagtagggaagaatcctacttctcagccacaaacatggctttcacatagcctacatatgtatcaattattaggatgagacaatgattgaaatgaaatcactaattgtgtctccttcctaccttccatctgctgatttatttccttgttctcctttcccatcttttttatttttttttattttttttaaattcatcggttctcctcctacatcatctagtgcatgcttacctacccttcttttcctaaattctctagttcccttcttccatcacctcacgcttcatcaatcatttcgatgcccatttttctttctgccttagctaaatgctgtggttgtgagcagctccatctgatacagaaaattagaacaatgacacaaaacattttgtggccttgttatgtttataattctttatagcaaaccgggtttgatgcaatcctatctaactcaaagagatgaacgaagggccctacttgagggatacgccccagaggtagtccccagggaggcagagaagaaagaaccaaagccagtacgggcaagggcacgccacgtgcgaatgctctgagagcacaaatgcaatgtcttggcatcaaaaggtgcccagatccaagcacacgtgcttgtccccgccaaagtccttcctccatgctttgccagcaaggtctgccccatgctggtgaccagtcatgaggttctgacaagcttgccatcgttagccttcgttagcaaacaaaagatcattaaatggaagacaaaagatagatggcaagcagccacaaaaatcactcaagcgaactaaatattttgcttcaatccagtaaccatgtttacagtagtgaacgatacatcataccataacaattatgatatttagtcctcagatatagatatatagttttcacaaatctatcttgtggatatattgtggggggaacggagccagatggatacatgcagtcgtacttgaatacgttaataagcaaggcaggtatagtaacatgtggtgtgcctggaaaagtaaatgatgcatgggatcctaggtttccataatggatctagtaagtgccgctctaaaattgtttaatggagataatagtgaaaagcctatggggatcacaccctgatgcacaaatgtggcgagttatgtttgatatttatctatcctctctttattcatgtatcgagaaaactatactttaatgtagtctgctttgatttctatttatttgtttgaacctaattttctgattattttagggaccaagtagattattcttcacaatcacttatgaaggtggtaatggttggagaattaataaaaggtgttgatacggtgcttccagctatcgttttagttgaaaaattcaagcagttcctgccggatgtctttcaaggttaagacagcaaagttttaatatttgtactcacctaccttaatgcccggcacatggaggggtcttctcttctggaaatctcctaaatgtaattgtatatattgccaggccagcaagtggctgacttatttatatatgcgacattgttattttaataaataaaatactgtattaatttggttatgggcggagaaggtttaaaattctaacgtattctaaaagtcagcttgattgattctcaactgcatgcagcagcagggtatgtatgccaccaactgaatagttaattggcttattgacatcaagggaatctgaacaaatcatccttggattttgtaaaataatatcagttttcatctcgagatttattaaggtgtaaattctctcttaatctagtgtggagtcacaagaagatacttcttgttatgatcatgggaaatgttgaggtgtactcttggggggaaaagaggaaatgtcatacaagaaatcttctttagcttttccccctttttttttttttttcctccttttaatctatgctcagatttaagataaaaacagaagatgaataccattgacaataaagtttgtcaattaatttgcaaccggggggttggtgctgctgctcagttactccactccgaagcacttgcactggggatcgaggtcccaaatccaggtctaggtggtcacattcccgctatagtttcaggaaaaaataaaaaagaaaaagaggtagaatgtttgcagaagcatgaatactgtaagctgaaggtcatttcttagtgacaactttaccatgcttgagtgaatgatatggccccctacatttcagcctccctagcttttcttcagaagggaaacacaaacaaacacacaccaaaaaaaaaaaaaaaaaaaaaaacaacaagggtatggccccttacatgaatgaagcgaaaagtaaaattcataaattaagcggccaacaaatagatgagataaaactgctgtcacgactattccagtaatgtcattcgaatgttttaggtgaggtcttcattattaccaaaagagatgtggacctcatctccattggtccaccatgccaatggcaagaggaaagtaaaagagataagctgtcataatccatgtaggcttgaattagctatcaggttctcaaagtaccggacagcatttagtgctagatttgcatcaaaaagaaacattatggctacacattgctcgaattacaaagttaaacgatgtaagaagagcatggagacccatgaacatgatgctcactgttatttatgtagaaattaagctttcgtgccttctcatttaaagcatttggtttaactggctcctttctaatttctattatccaccttttgtttaataaataaggaactcccaggttgagggttcagtatattatgcaactgaccgcagatattgctatgtgataatatagattagatcgcaaattccaacaaatcacattgatccaatccacagaatacacacgttgagagagagagagagagagagagagagagagagattccatatatttgataggaatgtttatccaaaatagtttactaacatggaccaaggaaggaggcaaagccctcttttcttcagctctgtacattcattggtcccctcaataaaacccaattcatttacaacatctcttttcagctccaagtcattcccacaaccaacaccttcctcctacaaaacccggagaaagaaaaactgtgtcaattcagactctaaaaagaagcacaacaacaagaacaacctctctcactctctctctctttctcacaaaaaggggaaagtatggtttcaacacaagcaaattatgttacctgaggaatccccttatgatcgtcatcttttttatttggttgcacatctgaacgattcaaatcactaacctacaccaatatgaaatagaaataactatctaaaacaaaaagatagaagaatgatattagttttagattcagaaagggttgaaacaaaatttgaacatgcatgggttcctcaaaccttgggactattaacaggagagctagcagtatcttccagagagtcatcatccaagacaccctttgccttcctcttcttaaagctgagctttttgcagctctttgtggtctcagcaccggcagaaggcttccatgcaacacatgaagcagcatcagagatggaggaccctcccgcaatgctaaaagagcaaccatcttcttccttcctctctgatgccaagaagtcctcaaagtacatggtccaaccactctcctcagaagagggtgtcccttccttggagttgagagccctgttcaaagaggagtggattgactcatccatcataagggagaagggatggtgggcttgcacatcaagtaagagccccaaagtggttagtcatatatatacaacaaaggaaagagaacaaatgtagagagagagaaggggggtgttggggtatcacattagtgtggggtatagtggaaattgggggttaaaatcaacagttgcaaacaaaagacttgcaagggaacctgcaagaagaagatcaaggaagcctttgacctcaataacttgtgccaaagttctccgaagttctcctctttttttaccatatttttatctcctcttgatgctttttaataaagatttccggtcatcgatgacgtacgttggtcggtctaagccatgaggccgttgttgagccgttgttacattaaaaagacccagtataagttggctccacggccaagtgggaagaggatccttggttgcgcattaatacagcttagagcaagtcttgcgattataattgttacggacatgatgcgtaacatgccttctattttcaagtttcctccaaaaaattcaaagctatgccttgataggagtagcaatcgaatcttatgtagatggaataaaaaaaaatttatcaatctgaatccgatctaattattaaataaatcaaacattcaaatatgaactcaatctgtttattaaataaataattcaattcgatccatagaataaaatagattaagttagattaaatggattaaatagattaggtgggattttaatggattaaataggttaagtagatcagattaaataaggcaaatggattaagcaaattttaaatagatcttaaatgagttaaatagatcatatggattagagagattgaattggttatttaactcaatctgatctgaatattaaatagattataaatggattaaatggattaaatatcagaaattttaattcgatccaaatattaaacaaattaaataggtcaatttgtttatagtccaaacctattttatccaaactcgaacctcctgatggtaaatcaaatatgagtcggattgacaggtcgagtcatagtttactagacttacatcctaatctgaatctaaatatttttttacctactgaaagtaaatttatccaaaaatgaaagtgcatcatgcaaatttatacccatgtcatctaagtcagagtcattatttggacaagatggagaggattggcattatgcacaacaaaactttagttgggtagatccattgagaagattgattagatttggattcaaatattaattctgtattgcaggctaactagcatctagtctacctatagcaatttttttagtatttataatttatattaaaaaattaatgctatactattttgaagcactcctaataaccatcatatctcgtactacacattccgtagacctaaaaattccagatgcgtccagtatgttggttgcccgtgattttttaaataaagatcagcatgtgaacatcaacatagtcatctttcatgacacaatgtgtttcccaatcacaaccattaataatgaagctgtaagggttgtagaagtcaactagtgaacctacaacctagaaatgcattataatgttattcttctaattagaattagttttattaagccttaatatgccacccctttcctttaggttacatccatgggtcatattatacaggactcatgtataatatagccactagaccatctttatagaagattaatagttgagatcagccaaaaaacagggatatagtcaattcgttgcaactctcctccataaaagaggagaatttgatctcaaattttagtagagttgattttccagtgtttaacttgcaatattacaattggtgatcctcctccctctttttaaaataaaaaaaatcagaatatatacaagttactcattaattattatatctgttgcagttgagaactactatacccccacatgggtatggtatgtatgtacgtatgtatatgtttgtgtctgtatacatatgtggatcaatgtacgcagatatgatatcagtttgcttaaatgagcattagctttcagttagaaaggtgatggaggccccggtggtgactgtacccacatgggtgttgttatatctttttgacgggttgacaactccacgtgaacatctgttgacatcgttcgtgcactgagcgtcccctcatcaggagttatgaatgcgtcctgcatacacgatggcgcatgctcaactatttatcccgaaaatgaccattcaatacccatatttttgaagttttgcacaactttttcaacacctcagaaatctacccaactatggtctctcaaaatgcagccacggagttgattgtagtggtcctggaaacaagaacattcaattccgtcatcaaaaaattttaacaaggtgtttgtgctccgatccgctagttaattgtatttcttaatacgtttgtttcatgataacaaaaatattgaagtggaatttgtctcaggggttatatctttttgcttagcaatttatgattttaaatttgattctcggatcatgcacctccaaagacaggatgcaaccaagtaaattgaggtgagcgttcctccctctctctctctttaaactttttttttttgaagaaacccttctctcttgaactaatgactattattagtcctgttgagctttgattcagtgcactcctatgaaagttctatgaagtcctacaatgaaaaaagaaaaaaagatgataacaacaaaacaaagttagtacttgataacggcactattcgcctaatgaacatttttcatattgatagagattgaaattttaagttacaaaaaggaaagtgtcgaataattagtaaatgttacaataagataattagataacaacagcggttggttgaattctccatctacatgcgcatcacataaagcgaaaccttccaaaaagacaaacagccatcatttagactgagtgtgatggtgttcacgggtgccagctagtttttaggtccggtcccttggtggttacaatgtagacgtggtccaaactctatcactgctaagctataaaaacctagcaattctggagtcatataatcagaaatttccacgaaccttgtctatatatatcttagtagtcgcaattattttttttttaaaaaaaaggaaaaaaagctgtgacactgcccacccaatcattgggccagaggttgttgtccgagttgccccacgtggactgtccactgccctgagacaaaaaaagctccagcccagctgatggcctcttccctaaacgtaggcgagaacgaataggccggagggcttggtgggaggaccaaggggagtggggtgcaatataattatgaggcaccttgtcgtcatggcaaagctcctggcaaccacgtcggttgggcggttccttttctaatccgttgaaaagaagaacagaccccaccttggattgacttgagttgaggttgataaagaagggtgcttgactttcttgggaggctgccatatggggcagatcatgattctgcgtgcccatgagacgatgaaaaaataatggccctttcaagtttgctgagctcaatatcacacctctctagttcattttataactatagagaagacctgatcttagagaatgtgccaataaatcattacatgttagattgcaagagaatctgttccactctcaaaaatattccatgcgctgatgaacttgatgtttaggtaatcaaattatagtgttttttttaccctgtaatgtgagtcaacaagggttttttttgcttcttgtttttgataaaagaagagtcagcccaattataatccacaaaagcaaggaccgacagcatcaaccaacacaagattattcaaaaataaaggaagactatgagagaagaatatccatataagcatatatttaatcttatatcagctgtgtattatgtaaattttagatacttatacatgattaagaaatcaaataacatcttccaaatagctttctttatatctggattgttgtaaatgatatcaaagtggattcaatccatgattcacataaaatagaggacattggatcacgagcttttttggattaactatgagttgattatagtgtttgtggctcagtttaaatgaatttagaatcttaactcggtatcatatcagaatctgtacaagtatatatttagtcctatattgactatgtattaaatagatcttagatatttatataagaccaaaaaatctaaatgacatcttctaaatagtctttttggataagatcctcgattgttacaagaagatatcagtccttatttccagaaggcaatgatatataatgagaagtgggttaattattcaatcatgcaatcacaatacttgagtcaccttcggtgtataatttggaagcagtaatcatagtaacataaatagatgaaccttgccattaaaatccaaccatggtaatctctaattatgaaacttgccctagcactcaaccaatgaatcgaactacagatgaggaggtgccaatatacaaagatgccgttaatcagcatggttgaatccttaagtctcaaatttctaatatttagaaggaaaagtttagtatataattaagcacatggtgaagttctttttattcttgtgcagcacggacagtgttttcattaccttgtaatgattttattgggttttgttttgatgtcgaatggaggaagtgagaaaattccccctagctaatttattattgaggaacaatgtacaaattatattcaaggagagctgtaataagtatgaattgaactagtgaactctagaaggaatcaaagatgtgatggggatccaatcctcctatgaccatcaatcatcttgtcattacaaagatttttcctaatgatgaaaagttagcaacacccttcaaaaaactgtggagaagggaatttttcttcttaggaagattcttgtgctccattcgtgtcaaaattttcaatttatagcaatcaataattggtcccatgctcttcaaatgggcggttggatttttttttccttctctgagaagtcaaaaatgggtataggttgggtggccatcttttcaagttaagagttgtcgcaatagcagaccaaatgcattttgtgaaagggcatttaaaaaaaaaaaagtgcaaccccactccgttttggacttgcctaaggagcaactttgattataaaagagaaggccaataaataaaaggtaaaagggcctgctctcgaacgtgctttaagatttatgttgtcttctttttggtatgatcatcggcgatccaggttgctaccagagccgttgaggtggtggaagatggcaaaggagacaagggaccgttgaggggtggtgacaggccgaagacgagccggaaaagagctatacagggacgcacagtgtggttttcattagagccatcaccggaggaagtgaaggagcttatctggtgattttcgaaggttgtggaagtcccggaggcggccctccgggagcatttggtgtggtgggaggtgattgtggtagttggcaggagtcttggacgacgggtgtcgccggaactggtggccagggagttccagctccgaggagtacttaaagacgatgtcaaggcatatggactagagaagggactgctcctcttccagttcaagaaggcaatggagtgagaccaggtgctccgatggccgtggatggtggcagggcaagcccttgccctcgagccatggaggttgggtttcttttcgatggaaggggtaatttcatcggtgttggtgtgggtgcatctccctcaactttcagtggagtactgggatgtggaagccatccgaaaggtgttgtggcttaccgacgagctgatttttctcgatgagtgcacgatgggcctgcggtggatggggtttgcctgtgcatgtcttaaaatcgatctcgatcggccattacaaccagagattctggttatgggactggctggcaccttctggcagtggtttgtctttgagtgtctgaacaaaatttatcttcattttggatacttccacttgccagaggagaattgccgatcgagagatggcgctacagcaatggggctagctccagactgttggatgtataccctagaagtcaatcttgactgacatatttcatatctctaggatatgattttatacttattggacagtaatattaccattcatgtttatatgtttatgaatcattcaagagattaataagatgatgacatatgttctcaaagagttgaaaatttgaggaatgcatcattgatggttgatttctaaattactcatggtcataggatcatcatggggatgatgattaatccggataaaccagtacatggattacttccttcagatagatggatctcgagtctgtagtgtagagacactggagtgagagtgcaggtggttgttagagaataactagtactgagtgtgatcaatacgagaagtcacatggatgtctactcacttgttagtgactttctcgatgctgtagttgtatgactgatcttttgatctgagatgacactactactcacaatgaggctgctggagtttgactgacacatcaacatggatctcaatgagctcttgtagtagatgttggcgatagttgatccattgtaggagtgaggtgtacatcaaaatgggatctatcgatcctagcagaagagaatagtcctatataatttaaaaggttgagtccttaagtctatggccatagcaatatgattgatggaaaagagttttcatagaatcatatatggactcaggctgattgaatttatcatatggccgatattgaagtttgacgattcatccatgacctaccatctggtcgggactcacgatatgagagactgtatcatgcattaactatacctagaggttcatcttttattttgctgggttgccactacatactgcttggtgtcactggtggattgtgagactcatgaggatcatcttgatgatcaatgattcttgatggatagagttaaaattattccaacccattgaaaagagtttcaatgatattgtgatagggatgataatatatctcactaccagatagaatagaaccttatgggnnnnnnnnnnnnnnnnnnnnaagaaaattaattagcaataggattgttaattggctcaatttgattgagcaatggggcttgcatcaagtctaatttgattaaatttaatttgactcattatggatttaatttgatcaaccccaacaggattataagataaccccaaaaggatcggatgattagccctagttgaattaagatttgagtttgatccaatttttaattagactaggatatatgtattcttaattagactagaaatcttcattttcatagatgcaccaaattctaattggattatgattaaaaattgagtttgactcaagcacaaagaaagagtccaataggactaggactcctccttcaattaggagacatctaatctaaattaattagactccaaatcagatttagatttctatttatttgagtctaatctagtcctaatatgattaggattaattgatgttttaattgggtttaaaatagccatgtaatgaagagtcccatgttcttaaaactcttctctcgatgtcttaaaagagccccacgccacattgattttgtgcgcacacccatgccaaattttgatgccatctttgctccctaattagcatgtaagaaggactcctaattcccttagttcacgtgtactagctggatgaattccttggattgggtgtcgttgaaaaattggaagagtccatgaatgtttggactctttattcctatccatgttaggactccatgttagcctataaatacccaccttatgggatggtgaaaggagggatttagatcaggttgggatgtccaaaagaggaggatttggcatggagaaaaataaggagaaaggggcggtgaagaggtccttggcgtgaggtatttctctcttcctgtctcttctttcttacacaactaatagttagttgttaggacatcttcttctctccttcttgtctatatttagacatggatgtcttctcttcttcttattcaaaagttggataaaatttttatatatctattgtagagatttggtgcatgaattttaagaaaaaaaaagaagaaatgattcttctcgtgatctctagcgtagagatcaagatcctcctacatcttcttgttctctaagagtgttttaagagaaaagaagattttcaaccattaagatgcgatctctgtaagaaagctagtatcccaataagatcaaaagacttctgatcagatcaaaatctcgtatggatatccgtagagatcaaacacttgtacggctaaaagaaatctttggaagacatccatgatcatctattcgcgttaaaaattgatccatatccaggtatgttttaaatttatttttttctatttgatttctgtatctgaatcttatctcacatatgatgatcctgttatggtttgaagatttgatcttatgcatgcttaaattaaattaaatttaatctgaaaaatttttaaatttcactatatattagttttgtaaaattatgcgtacataaaatcataaaacttcaatagtggtatcagagccacatcatatatatgagataaagatttggattcaacacatgtagagaaaaatttcagatctaaaaatttttgatgtcgttctggcacaaagttgccctggcataacttgttatgctgaatgattatcctagaatgatattaaaatttttaattagattaaatttttagatataattttttcagtatatatgtgatatatgttttattatttaaatttaaaaaagcttcgagatctgttttaattcatatatatgatatataaaagcatgtttagggctaaaatttatttctatgacctaaacttatttatgtatgtgatacatatttgtatgcatgatctaaaattattttgagatcaaaatttattcttcatataaagaatttagatttaaaaatttttgatttaaaatctaaaattagtgtttgtgcataagggattggtcatgggtagatcaaattaggtcctgtaattagattacatgtaaaagtttctgatttgatcatgatgggtctaaattgatttagcagttgatcaaaccgagtcaagtattgattnnnnnnnnnnnnnnnnnnnnaacctaaggacttaatttgaccctatagctcgagtctaatttacctaagctaacatattcggatcaattgtctaattggtgtctaaggcaagtaattgaaagatagttatttaattggttttgttcgcttatctggtcaatttattgatttctaagaaaagcaacagggggatccccaccaatctccacttacttgaccaatttggaagattgagtcttaaatatggttgcttgatggtttgatttagcccatgccaattacatcagtcatgcgatgactgattagatgagacttaaagctaaatcttttcataaatattaagtccaaagtcttccactattgtagatgtacggacatgctatcggcgttgattgttctcggctggtcacagtggttcagttgcattgagaacatataaccactctattagcaaagaattactgcgggataaagatgaggttggacccaataactgttaggtgatggatccaatgatgattttgcacctgcttgtgaacggtgggtctgatttaactgagaagtgtggataataactgttaggtgagcccacatatcttagagaccaagtggctacaacatatttagagaagcatctaggcaaaaagttgtccacgcatcggtgttcattcatattatcaataactgttacgtgaggtgcacggcatcgatgggaccacaacacccactagaaatccaattatcgcatcaagatttttatttttctatccgaagagtgtgggagatctgataaaatagtgagtctctttttgcatctaaaaatttttaaagtaaattataaaataagtacaaacattcaattagaatttttgctctctactattcattgtgtcagcttccaaccctctagcttgaatcttagatattaaccgattaactgaaatcgattacatagactggctcacaaacttaaaaattatttttaattttaaaaaattaagctacgttctctatcaagttattctaatattaacaacttgtccaacacatagtcaacgagctatacttgatgagtagatagacaatgacaataaagataggtgctatgcatgagcacatgctcactgtctacaacatgttgattcatctgtaaatattgtaagttgatcagagtacacagtgcatatgatgtgtgatggatagttagtctatgatcgttatttaataatgatcaaaaaaattaaggagcttgaaaggctcgacataatcatgcacaatgaatttcttatgaatttgatcttacgatctttgattaatttatatggatagtttatagtaaattactatacaaaaggccatcatggcactttatctaaattgatcaaagtgttgataataaagaaatcttgaaagaattcagagataaatatctggagagcctaaagaaataaagacatacctagaataggtatgtcgttattgctcaatattatccttatgattttctcttctcccagttgagctgtggactctagtgtaaagtcaatggaaagatagagggctgaggaagtaacccttgaattggctataggacaatagttgctgctgtgactatgggtatctattcttcacgatcatcgtttggatttagttcttagagacggtctctatcatttgcatggtgatgcatatgtgaacttaattgagtaagcagtgattgccattggatatgagagatctaaaattgagatgaaccttaaagtatatatggactcttaggctaagtcgtattggaaaagaaatgattaacaaattgaagaatatgagtttttgggctcattgactgttgagtcaaatctagtttgtatatcatctctttgagaaaatatgaccaagctactcttgtgggataagaaaaaatgaccactgagaaacttgtctttgtacacatttgatgtgtgtagcccatgtgatgtgctaatcaaggagttgtcttaactttgtatatgagatataaatctaaaatttttgaaaggttctaataattcagatataaagtaaaaaaaaattaaaaatttttaaagatacttcgatcggatcgaggatgcaataccattgaaaaaaaaattttagttatctcataatatggcatggttttatattggactgctcctagtacatctcagctcaacaagataagaagagtcaaagaactatatgagatatggtctgatctataatgaaattcactgatttattttgtttctttaggaacatgctttatttctatgaatttaggttctctctaaacatgttcctaccacatcatatgagatatgacatggtgagaactgaatcttaattattttgagattcaaggatgtccagcctgtgtctagaacaacaggtggatatattagaggataggtctataaagctcatcctaaaagagttttggatattactttctgaaagaattataatgtgattgtgacacgacatgctatcttcttgaaaattatttaaccaagatgaagcagtgggaggaaagtctagctttaggagaatgtctctgaagagcagagagccttgggaccttaagaacctatttatcatcatgaaccagtagacatatatttttcttccatctcgtatacatagtaggctccaatcctcttgaaaggtattcaggtatgcttaacagaggatgtagagaaaatcatttttcatgggagatgagagcatagagatgatcccagaacctacaacaagacgatgtaagacatcgacttcaagaaagaaatgtgaaatagcgttcttgagaagagatcttctgaagatttctatatagaatagtctatagatttcacttcttgtgatatgagatcataaaatctataataattttggagttggaacttttaatatgatcaaattgtttgattagaaaagaagaattatgagtttcaaaaggatcagtaggagtatccaaaactgacatcgattaaaatatgattgaatatagatttttcataaaagatataagttgagtatcctaaagatctatagagatagatacaattggatgcttgtgtttttacagataaagtatagagactagatgctgaaagagttcagcataaaactctcagataggggtctgctatcctctcgggcatagtcgtatgccatataatgtacttaaactaatataaataatactgtaattgtcacaagtagatatcagttatatacaggctatgagcactagattgctgtgaaaacatccttaagctcttaagaagaactaaggatatgctcttaatttggagaaagatcaaagttagaagtgagaggatacagcaattcagattttatatctgatattgatggtagaatatctacatcatgaggtatgttcctatgtcgatatcttggaaggatttcaagtaatcgatcaatggaagctgagtgcactgtagatatgtaggatgcattctgattttaatgatagttgcagaattgattaacatgccatcagataccatgacaatggcaccatagtctttgctaaggagcctaggtctcatcagatatccaagcacatagaacaacagaatacatgactacctcaagtagaaatacatagaggtgtaaagaacaaacaccacatgtgatgcggttgacccactgataagtcacttagctagcctgagactaaagcttgtcttgtgaagacagagcttggtatatggcagattgtctttagtgtaagtgggagattattggatgtatgtcctagaagccaatcttggctgacatatttcatatatgtaggatatgattttgtacttattgggcaattatattaccattcatatttatatgtccatgaatcatccaagaaattaataaaatgatgacacatattctcaaagaattaaaaatttaaggcatgtgtcattgatggttgattcctaaattgctcctggtcataggattattatggggatgatgattgatctggatagaccaatgcacggatcacttccttcagacagatggatctcgagtctgcagtgtagagacactggagcaagagtgcaggtggttgttaaagaacaactagcactgagcgtgaccaacatgagaagttacatagatgtctgttcactcgttggtgactttctcgatactgtagttgtatgactgatcttttgatctgagatgatactattactcgcaataaggctgctggagtttgactgacacatcaacatggatctcaatgagcttttgtagtggatgttggcgatagttgattcattgtaggagtggggtgtatatcaagatgggatctatcgatcctagcagaagaaaatagttctatacgatttaaaaggctgagtccttaagtctatggccatagcaatgtgattgatggaaaagagttcatagaatcatatatggactcaggctgattgaatctatcatatggccgatgttgaggtttgacgattcatccatgacctaccatctgatcgaaattcacgatagagaaactgtatcatgcattaactatacctagaggttcatcttttattctgttgggttgccactatatactgttaggtatcactggtggatcgtgagactcatgaggatcatcttgatgatcaatgattcttgatggatagagttagaattattctaatccattgaaaagagtttcaatgatattatgatagggatcacaatatatctcactaccagatagaatagaatctatggagtcacacacnnnnnnnnnnnnnnnnnnnntaactcgctaaagagttagtgagttatagaaggattaattagcaataacattactaattggctcaatttgattgagcaatggggcttgcatcaagttcaatttgattggatttaatttgactcattatatatttgatttgatcaaccccaacaggattatagaataatcccaaaaggatcggatgattagccctagttgaattagaatttgggtttgatccaattcttaattagattaggatatatatattcctaattagctaggaatccttattttcatgagtgcaccaaatcctaattggattatgattaaaaattgagtttgacttaagcaccaagaaatagtccaataggactaggactcctccaattaggagatatttaatctaaattaattagacttcaaataagatttggattcttatttatttgagtctaatctagtcctaatatgattaagattaattggtattttaattgagtttaaaatagccatgtaataaagagtcccatgttcttaaaactcttctctcgatgtcttaaaagagccccatgccacattgattttgtgtgcacgtccatgccagattttgacaccatctttgctccctaattagcatgtaaggactcctaatttccttagttcacatgtaatagctgggtgaattctttggattgggtggcgttaaaaaattggaagagtccatgaacgtttggactctttattcctatccatgttaggactccatgtttgcctataaatacccaccttatgggatggtgaaaggagggatttagaccaagttgggacatccaaaaggggaggatttggcatggagaaaaataaggagaaaggggcggtgaagaggtccttggcgtgaagtatttctctcttcctatctcttctttcttacataactaatagttagttattaggacatcttcttctctccctcttgtccatatttagacatagatgtctcctctttttcttgtccaaaagttagacaaaattcttacatctctattgtagagatttggtgcatggattttaggaagaaaagagaagaaaggattcttcttatgatctctagcgtagagattaagatcctcctacatcttcttgttctctaagagtgtcttaggagaaaaaaaaattttaaccatcaagaagcgatctttgcaagggagctagcatctcgatgagatcaaaaggcttctgatcagattagagtctcgtgtggatattcgtagaagccgtatgcttgtgcggctaaaagagatcttcggtagatatccatgatcatttgttcatgttgaagattgatccatgtctaggtatgttttaaatttatttttttctatttaatttttgtatctgaatcttatctcacatatgatgatcctgttatggtttgaagatttgatcttatgcatgtttagattaaattagacttaatctgaaaaatttttaaattctgctgcatactagttttataaaatcatgcgtgcatgaaaccataaaactccaacacaaacaatatttttcaaccagaggagggtgatggcgattaaaggatggtaggtcctcatcttgggcctttgctactggccatccgctagcgggagttgccaccaggggatggggcgaaagggagaaggatgatgactggatcggttaggcccgagtcgttggtgagtcaacccaggttgggatgtgcggagactcactcagatcgagcgaaggtggttgccggagatggcaactggattcagtcggtgaaggtcacgcagcggtgatcgcccgatcggatgcatccgaagctgatgattggtcgatcgatggggggtgtgatgttgtcagtggacgatgggggttgggtttcgggcctcaatccgttcgccctattggctggtggaggaaccgcaagcatggatgggtgcgcatctacgaggggagttgcggggaatggcccagcccagcctaaaatgaaccaggcaggagaggagaagcgggcatgggcagcgagccagcttaagcaggcccgacccaatgaacttgacatgggtcaggctccagtgaagcccactagtcatgatctagatctggaggggcccaaaaaaagtgcaacaaagaaaaataaggggaaagaaaaggcagtgacctaagcacccacagacttggaggagttagtgggttcttggcgccttggagtcttctttttcgctgtcaggagcatgataggagcagagatggatccaccggagtgggaaggactaagttggaagcctggtggcccagtggaggtgggggcatcgaggtggagggccgagctagtgatggcgggcaccccacccaagaggatgacgattgagggtctagagcacatgcaggcctcagatatcgaacaggacctcactcatgaggttgcagtggctagggtcagacaggctatctgagatgaggggacagccattaagataaaggaggcttcagatgttgtgggtgacatggactcttttggtgaggggggtacgagtgcaggccccctacctggtgagtcgtctccatgaggatttcactctaaaattatcggggggcgaagaagccctcccttcgatcgactttcgcttggttgatccagcagcatggtcctgatatttatgtgctaagcgagacctgtcttttctagattgagctggtcagggtcaagtggaggatctctatggcttagagttcttatgctgtggagtctcggagattgtcagaagggatcttggtgatgtggcatcgaggtttgatccaagttgatacatttcacagtgtgagtagcaggtggtccttgttatcatggaccagtcctgacggccctggctcctctctggtatctatgcaagcactgagcacagagatcggagggtgctctaggtggagatttctagattcatgatgcaggacttgccttctctagtggctgacgacttcaataacattgttggccctttcaagaagtacgacagcaagcagaagatggatagtatggagcctaaggagtttagagagttcattagtagcactagtgctgatcgatctcaaatttattggttcaagattcatctagtgcaacaaccgacatgggtctgctcggatctaagagaggatagatcgagctttaacttttactgaccggctccagcgccatccgagatactctaatcagcatctgccgaggattgtctcaaatcactgccccattcttgtttcaatggatggcctggaccgacctaggaccccctttcgatttaagaagctctggatcttctatcttagatcctgaaacttggttcgggaggtgtggaggatgccgatctgcagggatgcgaggtacagggtgactcgtaagctggagctagccaaacacaggctccttagttggaactgctttgaggtgggcaccatcttttgacaaattgagtggatcgaggctgatattgaggagctgcagctgagggaggaccagggaggtggcttaccttagcatgagttgggagagctgtgagataagctttctgagtaccactcttttctaagatagcaagagattttatggagggagaaatctagaattcagtagattcggaagggagatcgaaacaccaggttctttcatcagtccaccatgattcggaggtctgccaaccgtatcaggtagctgcgaaggaatgatgatagtgttgtagatgatagtggagggatccatgttgagatccttcattttttcaaagatcaatggatgaggtcgctttgtgaggactgtcccattctgggtggtcgatcagttgcccgcatctctgcataggagaatgagattttaattagatcagtgtcttctgaggaggtgcatggagccctttggtctcttgataaggataagaccttggagcctgatggttttttttctctcttcttcgatcggtactgatcgattatccaggaggagatagtggaggcggtgtaggtggcattcaagtccaaaggggttctaatggtgtggaagcggacccttattatccttattctgaagcggtcagatgcttcgatacccgagcatttcagatctggtccaatctctgtactactttctacaagacgtgtgtgagggttctgattgggtggctgaagctgctgatgtcttgtctgattagtccagagtcggatacttttattaagggtcggtctatcaccgataatattttgcttgcctaggagttcatgcatgacctctaaagagctccatgttgccatagtctcatggccatcaagctggatatagagcgagcatatatcggatgagttgggctttcctctggcggacgcttcaggagctgaattttgaggagggatagattgactggatcatggactgtgtcgagcacccgagcttcaccatcttcgttaatggtaccctgacagagttctttttttcttctataggtctttgccaaggttgtcctctctctcctacctattcattttatgtgctgatgtcttatccaggatgttaagagcagcgattcaaggacagaccttggagccatattggtctgcccctagtgtcctgccactctcgcatctattttttgcaaatgactgcctcctcatcgagcatgatttcactcaaaatgcgaagtattttgcctctattatctgggcctactactagatatcagagtagttggtcaatattcagaagtccgtagtcatctttaacccgaggatgaaggcccaggtcagtttggcgatcaaggagatcctgaggacttgggagcgtcaaagacactgacctatctcagggtttcgatcactaaccatcgtttacagcgaactgagtgtagacccttgagcagcagattcagaagtatcttcaggaatggcaggccaatgccctctctttcatggacaagaccattttggtgagatcaatgctgagctccattccgatttacctcctgtcccatacgattatccctgttgcttatatcagagggatgaagtagcagctttgcaactttttgtgggattttggtggcgatcgtcatcgactccatcagctctcctgggaggtagtgtgtcaatctatgcaggatggtagcctaaggatccatttcttattaacgaggagggagactttgatcgtcaggcatgcggtcagatttttgatccagttggactgtttatggatcatggtgatgagagttcattacagtgggtggagtcatgggactcccatccaggctgttcggggctgctctttcatttggaggaagatttgtgcttgaggacctgatgtgatggaccaaatcatgtgcttgatcggtgatggtcgttcgaaggaaatctagggtgcctagatttcgagcatttctttatctcgctggccgatccttgtcagtaacaagatggaggatcacatgagagtgtccgatctcatcattattgctgcctccagttggcgcgcacaggagatcacttggctctttaggcaaccacttgctgagcggatctttgccatcccgatttcgatgcaccccactcaggatgtgaggatccggggatgttcctactgcctgaagatttctttgagggacctctttcatttatatagatggatgccttctagatggattgaggctatctggattttgagagttgcaactcatcctatggtgcagatttttctctgaaaacttacttggaaccacctccctacacggacacttctctgggagaggagcataaagattctgttagatggatgtcctaaaaaccaatatgactgacatattgtaattaatctaggatataattttatatttaatacattgatttgatcaataaaagaataaatttatttttcattcaagtgtgatgtgtccttgagtcgtccatagaattaattttcaatacatattctcaagatgttgagaattagagatatgtatttagttcttaaatacttttgattataggattatcatgaggatggtgattaatctagacagattgatgcacagatcgcttctttcaggatagatgagtctctagtctacagtatagaggtactagacgatgagtgcggatagttattagagaataactaatactgagcgtgactatacgagagaacacttaaatttttattcaattattagtgattatctcgatgttgtagttgtgtgactgatttttttatctgagatagtactactatttacaacgaggctgctggagtttgattgatacataaatataggtctcaatgagctcttatagtggatgttggcgatagttgataaactataggaataagatgcacatcaaaatgagatctttcgatcttgatagagaggagtactcctataagatttgagaggctaagttcgagagtctgtggccacagcagtgtgattgatggaaaagaattttcatagatttgagctgatcgaatttatcatatgactgatgttgaggtttgacaatttatccatgacctgccatctagtcggtactcacgatagagggattgaatcacacgttaattacacctaaagatttatttcagttctactggattgccactnnnnnnnnnnnnnnnnnnnnggggtcatacaacaaagggattagatttgaaattagcaattgagcttatgaagtatcaattaggtttagaaaaattcgattgggttcaagataaccttgctagcacatggttggacccaattttttctttatgtttggatttcttatttgataagataattcaaacttaattatttgttaataacctatatgaattagatttattggacttcaattgttgggtgtctaagattttggatcatataaattaagggtgcaagtccttaattaatattccttgatagttattatggggtgccacttgatttgatcaagttgggcgtgtcccatgattagaaggcttatggatcccatataagacgtcccttgggtgcactttggggtgtatttatgtgggtgcaagagctccaagagttggcacctaaaaggattcttaaaggaagttgaataacttaagttattaggaaacctaatgcaagtaggacttgtattataagattgaatatgatttaattcttatgtctatttaaaggaatctctcctaaggtctctaggcatcccaactcatagcccacacccacaaaagagagcccccacgccctctcttctcctcccctttttttctctcttgggcgtcccacacgccccaccttaggcgtcccatctcttcttgtgtgctggttcctgatgtttgatagcagcataaatcaaggaagaaaggcaagagaagaagagaagaagaagatcaaggaaagagatcaaagagttaatcgcgatccaagtttcgttcagattcagcaggctgaattttcttagagaaaaaaatttaacttgaagaggacgtttccagactgatcccgagtggatatccatagaggttgaatatttgtgtagctagaaaaaaatctcttctctttcatatccagatttgaagaaagaaattacgaaacaggtatgtgattcgatcacattcagcatatgaactagatccttgtggtttgtattttatgcatgcaacatataaattaaaagatattttaatcttctcttccgctgcgctgttttgaaaagaaagttttgaaatatacatgcataccccaacatacgaattccaacagattctgaccttgtgtacgatctatggtatggaggatgattctacagagcacgcaatcctgtggtgccctagggtgaggatcatttggagacaggtggatagttacccatgggagatgagcattgatctatagttggtatccttctttggcttcatccgtcagagtgtgacttacagaatgcctatggttggtgggcgaatggcttatattacttatcagatttggctgtctaggaacagccttgtctttgactatgagatcattcctattcgttaggtgctggagagagcagtctgtttggctcaggagtactgccagtttgacacagccatatcgtcctgcgacatctccgacctttggagctccctggctaccccggcagcgactcgtagggttctatccatttcttgggagccctcttcactggggtttgtcaagattaactttgatggtagtgtcaggggcgggaggggtagagcgggctttatcatctacaacccagatgggagatttttggtggctggtgggtcttatctttttggatcttcgatttcgatggtagaacttcacgttgcctgggcaggtatcacctttgtcaggcatcagcttcatgcagagaggatttttctgaaggatgactctactactgctatttcttagattcagggagaagccagacaactcgagggtcatccacttatctgagatgtttggacctcttttcatcatgctgctgcagtgcgagtccggcatgtctatcaagaggtgaacattgcagtagattagatggcagcttttgttgctgagcactctaatgattggttgtggagacaggatgatgactgtctgctgattttgtgaaattttgtgtatcttaatcttttggattgctctcgcatcaaattgatataaccacttgtttgtaccaaaaaaaaagaagaacaagaagaggagagcaaccttgactcaccatccaacgttttctagcaaggatctccccatatgcaatatattcttcaaggccagctgcttaaatttctccaacactatggctttccaaatgactttgatggcttgtaataattatactggtttaaatgcatgtcatgtccttttcaaaaaacattcatgccagggccaatgttctgatgccaaatctttcggcttggaaaaggcctttaaaatgagctaagcttagtcttatgatgccaccagtctcgccacctatgatgcattatttcaagagccatttgtatgaagctgaaaactaacccgatatggggccctaatgcgtacgtgccgtctatagatgctttgatccctcatatgtctcaatctagtatttcatttggtaattctgcacaacttgcagagatgacatattattgcaaaatatcacatatacagtgaatctaagaaaaatttctcagaaaaagcttgagattgtagagatatttctgaaatattcttcctcaagtttttttcctactcctttcacacatatcacaccgatggaacctctttcttgtctctgcggaatagacagatagcctcctatgcatcgagaaagtaaataggttagcatgttagtaactatctcccacgatcttcactctcttgccttcctcctcctcaacatcccatctggccaacgtaataatttaatccctcatgtctcgttgtcacctaatcctcatccgaccgacattctctaatccaacatccaattctttattctgattgttctcaacgctttttaagccatgcttgccatgacagctctccgagaaggctttttttttttttttttataataaataattagagcacttctaatcatcattgtgtcagtggcaattacatggtgctccaaaactggtgcttaaaagattgcatggtctttggcatcgcacatgagattgttgaataattctcggtggagaaaagaagagctttttatctactaaagtatgggattgttaaatattaattcttggtggagagaacaagaacatttcctttgaaacatgtggacattgggagatcgtaatcaaggcaagggctccacctagtcttccaattattctcctaattcttcattgaatagtatccgagcgaagcccgtgattaccgcgcacatgagagcacatggtttggatgcggatgccggctgttaaggttgtgatgtgatgtctggtgcttgcacggctacttggtttgggtctgcgtggcacatggcatgttggatgttgtacttatcctgctagaaattaagatttatttggattatccattaaaataaaaattagcatatttttttgagcaaactgatgataaaaagcctatcatatattttattaaaaataaaatgagtgtaacaaaacaagagcaatagatgtattatttgcgattatctaacttgctaatatgtccgtggacttttgtatcagttgtttggaccctcgtatactcttcttgttagatggtactgaattattaaatctgaataactatagcaaaggggagatgcataatctaatttaaatttattaaaataattttttacattaaagatattcttgtaaaaaaagttattgacaatcaatctaataatgataattgaaccattttattgttgcattcgtatcatctgatccggactgtgtaataaacagacggtttgttgttcaaccatttacattccaaaatagatagttctcacattttgatagtagataactaagcaagtctcatcatttggtcgattacccattgttgaatagtgggatccacatttgaggatggtagtggtggtgcagttggactacttggatttttcaagaactaaaacgtatgatgaccctctaaggtttttacattggatgttcaattattagatcatatgatgaagttcttttcccggtaaaaaaaggaaacaaaaaaaaggattatattgagatactgctatcttaaatttagatttaaaaagattaatgaatcagcatgatataaattattgctagttcatccagagatgacatttttcatgaaaattttaactcctaatcaaagagctaatgacaatggggattttttttttcttaatctcatttcaggtgatctgtaagtacatgaaaaacaggatctaagcatagtaagaaaaaagaaaaagtacctacttcaattttttttttaattcatattttctttatatccaaatatcaaaggagccctccgttgacgaaaacttgaaagataaacttatctaaagatccttatatggattacgaataactgattatggcttataatttataactaaaaactaaatgcgaacaaaataagaattgtagtggggcatctattttaattcgaagaataaaattacttatagatcttttaatggatcatgaatcttttttagaaccaatggctttaagattcggcatttttctaggttcgttttaatcgtatcttcttcttccgcattcttttgctctcttttttatctctttaattaaaatattagtactctattttttttatacattactccttctaattcattttttttattctttttttattaaattttaagaggatgtttggatggagagagtgaggatttggaatgggtgactcctatgccatctgtttgcaccacacttcatctttttctcaattcattccatgctctattgtccatctatttatacaaatcttaattcacaccattttctatcgttcggcctatatagatctcaaaacaatccatcttttatcatccatctgcctgcatagatcttaacatactcaatcttttgtctttcatcagcttgcatagatcgcaaagcactttgtccatgcgaatcttcttttcctcctttttcaattcatgccaaaataagagccccttgctaaattaattagtggaaatgataattctgaaattttacaaaaatttagttattagatgattctctcgtgataatattttgtaatagaaatagaataccaggctatattgcaacaaatttaaaattttgatgagtaattaatacttttcaaacttttgagaataaatgacccaaacttaaaaaggtttttctataattttataggtgctgtgatcgtagtagagttgatcatagactagaactcgggcataactgcattcattttaggaccaatttaaaacttgattctcagtacccaagcccggcccaactatatttacttttaatcagtcttaggaacaaatctatttaaaacttgatattttttgtgcttaaaatttggcctaggatcagctctatacggtaggcttagacgccttgcactcccaaactaatttagcgatatatcgaaccgacaaactcttacccaggcccaaaccacaggctgataaggagtcatgatctaaaaagcgagcccggtctgtcggacgacgttgctctctaagcccatcgacggtcacgtgtagtcaggcggctttccttctctgagcataacattactccgaacgttcggataataactttctgacacacggagtccttcaagaataataaacatgtaatcatgtgtacagcatttggaaattattcatctttaaaatttcaaatgtaagcaactgtagaactgatcttacactcaaaatccttcaagaaatcctatgaggagcatgcatccggtgccacaaatgttatcgcataatattttattctactactaagaaaaacttttccaatgcctctactcgcagggctccatttcatgcatctctaatttttcaattttgacaaacatttaaattttaattttttaaatttttttatttagtaaatttagagtttaatttgcatcttttgaatagcctacttctcaaacatatgcaatggtagaaaaaaaaggtaaggaccatgttcaccgtcgaaaaagagagagatcaaaattttttgaatattaaaatatttataattaatttatcactacatatatatgcatgacacataccgattgtagttttaagttatagtgctcaccgattttgaatttcaaatttatgtagccttttcagtgaatatgatgaccacatattacttcaattttgaagtaagatgcagattttttatgattaattatataattttattgaaagaaaaaattttaaaacattaattttatatagctcaaatcatgtaatgactaattattattaaaaatataatattatatttatttattatacttctgtgctgatgtaatgatgatgaaaataaaccgtacagctaaacttcactgcgaagcaacagcaaaaacgtttggcagaccacttgcgggataagttccttacaaagtgcttcacgtctaatgtgttttatagcggtatgtcatcagccggacacatgaaagacagttctacaagattagctgacatcatggtgatagaaaaagatatcccatgttaattattccacttggattatttgaaacaaaataatatcataactggaatgagcaggataactgggatagcaaagtacattggaccatgctaggggaaaaacaaagttgcaaaagagcttttccacctgagcagaacattccggggccaattggagctcgaaattggatggtaatcctacgacttttgcatgaaggcgagatactttaggatgcagtccttccagcccctatttttattacagatagctccctatatctcacaaacagggggccttgatgtcttcccaccatcccggttgtccagaagacatcccaacggttacatgaatggtgggccccacgtgaagcccacacaccgttttttcggcctccactgcccgctccatgcccggttatcttagaacgagaaatttaaaatatcgcatcgtgggatgatcatgcaaattctcttgctccatttttttctcagctgataaattgataaaagcataatcttcctctaacatcccccaccccatattttgggaaatttcataagccagacttttgagtgacttttctttttgtgaaaaacatgatgctattattagtaaactactaagttcattttcttggtctgtactatgcattaatagttagattttggatcaaagttattgacttttatggacattagtgtaagttaagatggatgcctatatggtcgagagatagtgattacatgatctacacaaatctaaatattaattagatgctaatcttggtgcacattaaactaacataaaatgaattgttagctttacttccaaaggttaaatgaggatcatcttgtcctaccatgtttattatgataaaaagtaagagttcgatgtgtatatataagatgtcaattctgatgctccaacattgtgtcctctatggtattttctaatagagaagtttaggaaagatcagtacgtatggatgtagagctatgatatgaatgaaattatcacaagcaacttgtttttagttaaaaatttgatataataaggactcaatcaattagtaaatagcttcaacttggtctatgttctaagctcaaaaaaaatttcaaactaaaatagaaactcaacatacttgtttatgttatctctagttaattatatatttttcatattttactatttattatttaactatcaaaatctactccatatgacaccaactcttcctatacctttgagaattcttccttagccactactccccttttttctctcttctctttttattcttattagcattcaatatgcaagttgtatacaccgtgttttctcttatgttcctctcttcttcgcatgagtccaaattttctcatatatatgtcatcaatcacgtgttttgtatgtatgatattctagtattaatctaatggctaagtcgaaacatttaactcactaaactaaggtctaatgactaacgtaagctccatgtgtggtaaaagtctttgacacttcaagctcttataagtcccttaaagaagtaatctgcgaacaattaagcttaattagctcaaaataaattgatcaaagactcaagccaagagatatttttttgacatataataagaccgagcaaggcatcctcgaaattgactcggttacatgttcaaaaaccctagatgtgaatggtaggatttgtcttatacatgttactgctcttttgttgcttattttggtgatttgatcaagagttcataattaggtacacagttgcaagaataacaaaaataatttattttatgagataaacacccatgagcccataagacaccttaggaacatatttgattctctctattattgatgattatagcacgacgtacgtgttggatgtggtagttgaaagataacgagcatggaggtatagtctatataaggtattgataaagtcactacttctagggtttaaaatagccattgaggaccaaaaagagtttatgaggaatgaagctactaaatgactaatcaccacgctatctccccatgcgcctcatcctagcttcatcaccccgatgtttggcccttcaagtggggtttttgtgaggggttatctaaagaataaggtttctcatgtagcatataagcaaggaatgaagccattgcatccaaatctttaaagtttagcctaggattacaaacttccaatggcatgaaactctatgaaaagcttagtatagggtaaattcactcttttattcatttgggttttatttacttctggttgtggggaaaagggattctttggctatattactctcatactaatttagtaccatgtagttcaatgtattaactgaaccaaaaaaaaagagttgtttgtttggcaagtgaaaagtacttgatatgccttccattccttaaaaactatggactcaagggttaagagaatgttttaagttcaagttctcttaatttcagtcatataatatatttattgttccaatgtgtctcattaagcatagacctaatctctagtgccagtatgtggaagaaacaagtagtactatcaaagattagctgtatcaaaaattcaagggctctactaaaccaaaatagagttagcgctacatccagccacaattagacattagcttatatattaagtatttataagtcctcagtttcaaatattcaataatacatttgtcccatcaaaactgaaggttacaattattgtaatgattgagtcattttttaaacccatcttaaaagtaatatttccaaatttggctcccttaatgcatagcagattcttatctattgaatgttcctctcatgtttctctaaggattaaatccaactgtaatagtagtattgacgtcatggtctcacgtactaggtatgtatacttgcaggcaggttcttatatgttgatattcaaagttagttcagtttggtcatctgatcatttagaactaatgttgaattgatgaactgttattattagagcgagttctctattatttatgttcttcctagttattttggaaagaaatactaagtatagtgttagctaattatgtcatagtaaagatttaaaagtttgcgtatatcaaatttgtgaactacattgagctttaccttgattgtggtggagctcatgcaaatgaacacataaaataaataaataaataaaaaagatcaatcacattcaacaacaaaatatggaatataaaggagccgagcaactctatgtatacaccacttacattatttttcttaataaaataagtaattagaaaatgtagtcaagagttatttgaagctttccttttcttttcgaataatagtagcacaaccaccaacctaaacccataatgtttcgaacatgcacagaatgattttgatgagagatgccaactagcagaacctattagccatagtccccaatctaaagtgatatcttttttttttaaagaaagatagaagtcatgatcagcattactaaggttttgattttctttttttttttaacccttctagattttctttagcccttcaagaacaacagtggcactgccacctatctaaatctattttgattcaaacttagaatcttttccagagaaatatttgtggaacagtgccaattatcaaactaaaatctattaataaaagtaaaagtcatgaatctaaaacaatttggatttcgaaaatgatggaaatcataattagcatcatggacaatccaaccttctatttcttttttcttttttcaccctctgaagtaataatgtatttccacctatttaaaacctgttttgacttgaactaggaatatttttccaagtgcaatatttgaggaggggattccacagccaagtagctgaatttgacaatgtaaaacaatcttttttcgaaaaataggaaaaaatataatcaatgctattttgaactttagacttttgaaaaatagggtggagcctattttgaactttagactttttcaaacacaatatttgatcagaagggttgctcattagcattggaaatgggctgggttgtgttgggaagggccacaccctaacccaaacttggaccaattttttttgggctttaagccgggcttagcctgaaagattttggaaaaacacaagctcaagcatggttcgagcccgacccgagtttgacctaaacttgattgggctagctcaagtttgtagaagaggctgcaatttattgaatcacaaatagctttctcattgataattcagaattctaatcattttaatatatcttaaatcacagtaaactattatacctccagaggattctacagaagcttaaaaactccaatattcaataatttgtgaacacaaagatttaaagaaaaatgatgaaggatttaagatttgttcaaacatgcatttagtctccattcgggatcttattcgggctcaggctcaagtcgggccaataatatactcgagctcggtccaaaaaaaatgtgctctatatttaagcccaaactcagcctaaaatcttttgaatttagctcgcagtctaacctaaagtcgatccagcccaaattcctattttcaaccctagtgccaatcattagactcaaaacctattaaccaaagtcaccaatatgaaacaatcctattttcaaaaatgatagaaattattagtggtgtcatggacattggaagctttctttttttttatttctttatcttttcaaccctccaaaaataatgctgctattccacctacttgaactcgaaatattttccaagtgcaatatttgaggaggggatctaattatcatccatctggaaccttttcgtcaaaattgacaatgtaaaatgatccctttttttttgaaaaatgacaaaaattataatccatgtcatttgcagcttgttctgatgcaaagttggcatttttttttggtgcaatatttgaggagggtgcctaccattagactcaaaatctattagctaaagtcgcaaatctaaaacaatctcgatttcctataaaatgatagagatctaaaacaaaagattatttttttaattctttttcccttttttaactcctcaagaataataccagtactaccacctgtctaaacctattttttgctttgaattcagatctattctaagcacaataattgaggaggggatcaagcaccaaacctaaaacctatcaaccaaactcaccaattaaaaatgatctcttttccaaaaaatgataaaagtcataatcctcaattgaaattttcctcctttttcttgttgataattgaatcatgtatatctgaccaaccaccaaacccaaaacctattagtcaacctcaccaattcaaatggtcttttttccaaaaaatgacaagagtcataatcttgcatggaaactttccctccttttttctatcggtaatcgaatcatttatatctgaagatacggtgcatttcaaccttagattttgtattatatgctcttttaatttttttgatcgattatagcaatgtgatgtcaatcttaaacccttaaccctatcctgttggctcgtaaatgcgacagatgcatcatgcgtaatttattcttgtcgtattatgtttactacttagcagaattgatcagacatgcacagtccctccttaagtagtttttgttgtgttatgttaaaaacttaacaaaaataattttttctaaaaatgaatttatgagatgatttattttaatttttaacaattttttgccaattaattctattaatatatttatatgggaatatttttaatacaataatgtaatgtttggagttttgcagccttctttcattgcacaataggtccttgtggttaagacaaatagaatctctccttttcaaagcaattttattccttttctttcatgtaataaccttcattttcatctatttgattttattttattatatattttcgtataagcaatagattttaaggtaagtcccttagttggattgcgcaaaactctgaggcccttgatttatttttcctttccaaatgtagagggagagatgggatagagaaagagatattgcccgagatttccgcaagatatgctccctaaagtatttgttccccctgtgtttgtcttattattcagcgtcagagcccctttttctctctaagcgtagagttaaacattgtatactgacaacttgtaaccaccccctggccttccttagaacacaatgaagactttaaaccaataaggaaaaaataagatatgttgtcttgatttttatctcattttatctttccaaaatttgttttgatttttatgtaataatgcatgagagtgtatatccaaagaaaaggtggcagtgtatgaggtgtgcaaggtgataatgcatgcacttggcctcgtgcgactgtccgcgggcctccgcttggcacggcattttctattttaggtggggattagagtctatataagccaaaggagtgaggggtgcatgtcgatcatctgaggttgagttcttggtagggttctgatccggaaggcttgagaggttcgcaactttgttgctatggagtttcagggaaagtgggtgagttcttctgttgttttcttctccttgtcgcagaggcacacatagagacacatatacagagagagaggtagggagggagagaaagcaagctctcctgttcctttcttctccttgttgcacgggcacacacacagcatgcagagagagagagagataagagaaagcaagctctcctgttcctttcttctccttgttgcacaggcacacacacagcatgcagagagagagagattatctctctctctctctttctcggaaagagtctttcttcttcagtccacactgtgttaattttggtttatctacgtctgttctccctcgatctcttctgatgacagagatggagagatggaataatctttcttctaaaagctctctcatctctctctactctctctctctctctctttctcaaagagtctttcttcttcagtccacactgcgttaattttggtttatctgcgtccgttctctccctcggtctcttctgatgacagagatggaaggatgccataatctttcttctaacagctctctcacctctctctctctcccttccccgaaaagagtctttcttcttcagtccactctgtgttaattttggtttatatgcatctgttctcccttttccctttgctgcctccatattcccttcaaaaaaaaaatgcatctgttctctctcggcctcttctgatgatagagatgccataatcttttttctaacatctctctcatggaagatttttacttttattatgtggatgattttcatcttcagtccacatagagtggatctttgttgtgtgtgaattatggtccatcttcacctgccttggtcacttctgatgatagggagggagagatgccacaatcttaatttcttcatccagctctctcatggtagatttgtacgtttcgcgtcctgatgatttccttctccagtccccatagagtgatcttttttgtgtgtgaattttggtctatcttcatctgttctcccttggtcactactgatgacagagtgtgatagatgccatatagtctttcttcatacagctagctctctcatggtagattttcacttccattatatggatgattttcgtttttagtccgcataaagtattgggtgaattttgatctatatttatatgttctctcttggtcacttctgatgacagacatggagagatgccatagtctttcttcttacagctctcttagggtagttttttttttttttaagtctagtgatactttcttgtttcatccctttttcgttttttttttcctgatgttctctcttttactttaactaatcttttttatattacaaatatgcattttcggtgtcctttttgatagatctgtattaacatatatcaaacttgtttgtgtttaattatcttctctcatagattttcaattaaagttactattattttcctcattctcctaatcatgctttgtcttttgtgttacaaaagaacatgtttcatgatcaagcgcgggctcctcagcaaaatcatgatccacagtctttccagatcactacggggatcgaggctcccagactggtcgacgaggaggaccattctgccaacccgcaaactgaagtccctgcaaacgcttccactggggaagatgatcaacaacggagggctgctcccaaaaggaagaagtaccagagacacacacctgagcaaatcaaagagctggaagcgtaatatccccgaaggaccttccctgcttgaaatagattattatttggatcagatcaatttctttatttttgtcaccttttcccatcgtattttttgtttttctcgtatctcatcttttatcatttctagaaaggcattactttttcttcccccccccccccttttttttctagtcttttcaggatatgcccgcatcctgacgacaagcagcggaaagagctgagcgagaaagtgggtatggagccacagcaagtgaagttctggtttcagaatagacgcacccagtctaaggtcaataacttctcctaaacccctctctctttctatctcttctctgcacgtcagccactgaccacgattcccagctgacgtcacatttaacatgcctccactgcactttgtttactattttttctcgactaggctgctgctggcaacttctatatttagcatccttccactctttctctatctcttgttcttcgaatcatcttaccctttcacagaaccaccgagagcgcgacgacaacaacaagctccggaaggaaaatgaggagctgcgcctggagaacctgaggatcaaagaggcattaagtaatccatgctgccagaactgtggcggtccttgcgttattggcaagatgtccatggacgagcaccgattgaggttggagaacgctagcttgcacgcagaggtactcttgagagctctggtgttcgtttatgcacgtagtttatatatatacatatgatgttctgctgtacttgttggatttttgcagattcaaaaggtgtcggtgtggatttcgaagcatggggatcaacctgagacgccgtccaccgtgctgcccgagccagaaccctcgcatcagctggtggtctctggggtcgttactggcactgccacggttcctctttatacgatggaagcagagagttcgagagcagcggaactgcgcgggccgtccgttaccgtgcaatctcaggctcagatgcagaggccattcttcgaaaaccttgcagcggtggccatggaggagctcatggtgatggctcacgctgatgagcctctgtggatccgtggcctcgatggttattatgagattcttaacgaggatgaatacgcccgggctttcgcgagggggctcgggccgaagctgcccacgcttaggacggaggtgactagaggaacggcaataatatttacgactccgctgtaccttgtggacattatcatgaatgtggtgggtgaaagaaaatttatcacggctttgaaggcggtaaattttttttatttatatgctactgcatgcaacggttatgatttttattcttctctatttttggcagagcaagtggtcgactttcttttcaggcattgtttcaagtgctgattgtttggagatgcctttcattagcatcggctccaagggaatgttgcaattagtatggcctctattttttttggcttctagcattctatccataatttaaattaaaatctcgccagattattatggtttcgataattgctatataatcaatgaaattttctttttccaaaatggaaatattattctagtctatacttaattatttcatgagaccgaaatctaattttatacattcttagatcactgcggagtttcaagttccatcacctctcgtaccacccagagggtgcgtgtttctaaggtactgcagaaagcatgcagagggattctgggtaatcgtcgatgtttcaatgaacaaccatgataactcagaaatcagataccggcgaaggccatcaggctgcttaatccaagagttgtcaaatggctactcaaaggtaatgaagtaatgaaaagcaaaaaaattgattcctttctaatattatatctacctagcttctattggttggtttcctatgttgcactaattgttatcgcctcagatcacatgggtcgaacatgtcgaagtggatgattctggtgttcatgacatgtacaaggctgtagtcaattcaggtctaacctttggagcaaaacggtggctgtcaaccttggaaagacagtgcgagcgcctggcaagtatctcggccattaacaatccgcgctttggtattaatggtaataatcctccacttcgaccaagtaaaatccaataacaatatgaagccatctctctcctaacctgttcatttcgtatatattctgtgatagctaaccctgagggtaggaagaacattctgaggttggtggagaggatggtggtgggcttctgtggtggggtaagtggatcaagggctcagggctggagccatatatctggaatcggtgcagaggatgtgaaaattacagctaaaaggaacaccgttgctagtggttcaccaccgggaatcactgtaaatgccagcacgtccctatggctccccatgccgccagggagaattttccatttcctgcgcacctcacgcaatgaggtgttcagggccccttcaatagtgcgtcctctatttccctgctctcccttcactgctttcgactataattccttttgctcttatggcaagagcctttaatgagtgatcatattcattggatcatttcagtcataatcatggcttaaaatattttttgtaccagacccttaccttgtattgcctatgtttatctcatttcattgattacttactgcattgattgtattgcaacgatattgcaacggtctaatcaagagttacaaaagtaaatgtagaaataactcagttatttgtgataatgctagatgaattgttcaagtaatgtttcatctcattagcaattataggagattaattgattgtccaatgatattcatcattttactttcttttattgtatcatgacaattctaatattttaagtattttgagcaaatacttctaagattctcgcagtgattgttagaatttgggtgttttcattagtgtattgcattttaatgctctaaatgaattagcaaactaattaattagtttcacaagccaagattttcaaaaaaataatttcatgagataatattgtaaaattgagaggtattaatccgtccgacagaatgacctgatcttttatttcatccgcatctgcgttccaagcagcagattctgacttgtgagaggctaatgcttgtttcccatctaccaatctgctgttgatttgtgtggatccgtcatttttttattgtttgatgagaaaagtaaaacgaagactatttgtggaactacaaatttgtttcttaaatgaatcaaaaattatgcttcattatagccggtcaagtattctaaggtttcataaaaatattcttattatgggccgtttcacttcaattaaaatatattacagcccacgcatgtacttgatttaataaacccactgagagcatatatcattccacagactataaatttttgatgttactgaaatatttaaacatattgcttgtccatacatattccaacataagttcatgttgacatccagttaatgcatttatctgattagatgaattcaacctgaagcaaaagaattaacgcaatggcaagtgtctgttttcctttctccagaataagaatataataaaagttaatcacaaattcaggcactcagaattataagtccatgtctacgtttatatacatatatacatggactggtgctttgttctctatttatagcccatttactagttctataaatgatatttaatgataataaatccatccattaatataacccaatcttgatagactatatcctttgtaagaatttatttagatactcaaaaatgaaattgaagcactaacttagataatgatatttccctcacttgctcttgggatgtcagtgggatgtactcgcgaatggtgctacaattgaagaagcatgccaaatagctaatggcagggaagaaggaaattgtatctcgatactcagtgttcgcgtaagcttaatatataccatttccatgtctttttctatcactactgttttctagctcaactttcttttcatcaaaacaacatacctctctctctctnnnnnnnnnnnnnnnnnnnnnnnnnnnnnnnnnnnnnnnnnnnnnnnnnnnnnnnnnnnntacgtctactactttactttacttactaacaaacaacactactctctctctctctctctctctctctctctctctcacgtaaaaaaactcaacttactctacgttgcatgatggcgagtatatatagggaccggagagcccgagccacgtgatgatactccaagagaactgctcccatgcaactggctcgtatgtgatctatgctccaatcgatatcgttgcgctgaatgctatcctgacgggccaagaggccgactacgtggcacttcttccttgtggatttaccatcttcccagacttgccttatggcatgcaagatggcttagttggtgagggtggctccggaggatccctcttgactgtttcttttcagatcctggtcgactccaatccagattcaaatatctctgcggacaccatcgccaacctgaatgcgcttgtgaccgatacctgcgaccaaatcaaaagttctctgttggctaataatgccccgtgaagctgaaggaggtactgacataagttgatcttaatttccagaaactcaagtattccttgggtgttgaaacatcatttatagtttccttgctctgtaaaaaaaacaaaagagttttttatgtttaaggaattttaaggtactttttattatgaattatttcaagaagaaggtcaacttgcttggcactttgttccatacaaagtgcttgacgtttcatgagttttatagcggtatgtcatcagccggacacatgaaaggcagttccgcgagatttgctgacatcatggtgatagaaaaagatatcccacgttaattattctacttagattattcgagacaaaacaatatcatatctggaacgagcaggataactgggataacaaagtacatttgaccgtgccaggaaaaaaacaggggtgcaaagagcttttccacctgaccagaacattccggcgccaattggagctcgaacttggatggtatccaacaacttttgtatgtaggcgagatgttttaggattcagtccttccagcctctatttttattacagataactccctatccatatctcaaaaacagggggcttgatatcttcccaccatcccggttgtccagaagacatcccaacggttacatgaacggtgcgccccacgtgaagccccccccatcacccttttttggcctcctctacccgctccatgcacggttatcttagaacgagaaatttaaaaaatcgcatcgtggaatgatcatgcaaattctcctgctccattttttctcagcagataaattgatcaaaagataatcttcctctaacaccccccaccccatattttgggaaatttcatacgctagacttttgatgacttttctttttctgaaaaacataatgctattattagttaactactaagttagctttcttgatctgtgttatgcattaatagttagattttggatcaaagttattgacttttatggacattggtgtgagttaacatggatgcatattaggtggagagatagtgattacatgatctacacaaatctcaatattaagtagatgctgaccttgatacacgttaaactaatgtaaaacgaattgttagctttacttccaaagattaaatgaggatcatcttgtccaactatatttattatgataaaaagtaagagttagatgtctatataagatgtcaattctgatgctccaacattatatcctctttgttattttctagctgaaaagtttaggaaagattggtacgtataggcataaggctataatatgaatgaaattttcacaagcagcttgtttttggttaaaaatttgatctaataaagactcaaccaattagtaaatagcttcaacccgatctatgttctaatctcaaaaaaatttcaaatcagaatagaaactcaactgacttgtttaagttagctctagttaattatatatttttcatattttacaatttattatttaactatcaaaagctactctaatatataacaccaactcttccaatacctttgagaattcttccttagccactactcccctttttctctcttctcattttattctttttagcattcaatatgcaaaccatgttttctcctatgttcctctcttctttgcacatgtctatattttctcgtatgtcatctatcatgtgctttgcatgtgtgatattctagtattaatctaatggctaaaatgttaacagcttgtcaaaacatttaaatcactagactaaggtctaatggctgacgtaagctccatatgtagtcaaagtctttgacacttcaagctcttacaagtcccttaaagaagtaatccatgaacaatcaagcttaattagctaaaaataaattgatcagagactcaagccaagagatagctttttgaaatataataaggctgagccaggcatccccaaattgactcggttacatattcaaaaaccctagatgtggatggctatgtcactgctcttttgttgcttatttaggtgacttgattaagagttcataattaggtatgtaactgcaagaataactaaaataatttattttgcaaaagcaacacccatgagcccataagataccttgggaacatatttgattctccctgtaattgatcattagcttgacatacatgtcggaggtggcacttgaaagcagtggtgtagccaggattttcattctagaggttcaatatataaattaaaataaataaataaataaaaataaaattaataacattatattaattgaaagtgagagagaaagaaataagaaaaaaagaaaaaaaaagtgagagaaagaattcaaacttgggacgtgggggacggaaggtaagggttcaaactactaattaagctaattaagattttttattctatggaggatcaaaaatatatatatacaaaattttttggatagtagttacataccttaaggatattgcaccaaaatttggaggttcgattgatccccaaaccaaaacgtggctccatctctgcttgaaaggtaatgggcatggaggcgtagtctacataagatattgataaagtcacttctagggtttaaaatagcagtctagaaccaaaaagagttcatgaggaataaactcactaaacgactaatcaccgcaccatctacttgtgcgtgccccatcctagctccatcaccccagatgtttgggcctccaaatgggtttttgtaagtggtcatctaaagagtaaggtttctcacgtagcatatattcaaggcatgaagccactgcatccaaatctttgaagcctagattaggattacaaacttccaattgcattaaaccctatcaaaagcttatgcatttggattttattaacttctgtttgtggggaaaagggattcttcggctatattgctttcatactaatttagtaccatgtagttcaatgcattaactgaaccaaaaaaatattgtttatttggcaagtgaaaattactagatatgccttccatttcttcacaactttggactcaaaagtctagacaatgttttaagttcaagttctcttaatttcagtcatataatatattaattgttccagtgtgtctcattaagcatagacctaagctctagtgccgatatgtgaaagaaacaaatagtactatcaaagattagctgtatcagagattcaagggctctactaaaccaaaatagagttagtgctacgtccggccacaattagatattagcttatatatcgagtatttagtaagtcctcagtttcattagaactaaaggttacaattattgtaatgattgagccttttttttaaacccttcttaaaattaattttcaaatttggctcccttagtgcaaagcaaattcttatctattgaatgttccgcttatgtttctttgaggattgaatccaactatcatactagctatacgtacttgtaggcaggttcttatatgttgatattcaaagttagtccagtttggtctgatcatttagaattaatgttgaatcgatgaactattattcatagagtgagttctctattatttatgttcttcctagttattttggattttggaaagaaatactgagtatagcattagttatatcatagtaaatatttaaaaagtttgtacatatcaattttgtgaactacattaagctttatcttgattgttctggagctcatgcaaatgaacaaacaaaataaataaataaaaaataaagactaatcacattcaacagcaaaatgtgaaatataaaggagccgagcaactctatacaccacttacattgtttttcttaataaaataaataattagaaaatattgtcaggtgtcacttgaagcttcttttttttcttttcgaacaatagtggcacagccaccaatctaaacccataatgtttcaaacatagaatgattttgaggagagatgccaactagcaaaacctaatagccagagtcaccaatctaaagtgctatctttttttgaaaaatgataagagtcatgatcaatattacttgagattttgattttcttttcttcttaaaccttgtaggtttcctttatctcttcaagaatgacagtggcactgccacctatctaaacctatcctgatttgaacttagaactttttccaaagaaatatttgtaaggcagtggcaattatcaaactcaaacctactaacaaaagtaaaagtcatgaatctaaaacattttggattttaaaaatgatagaaatcataactagcatcatggacactccaaccttccctttttttttcgtttcttttttaaccctctgaagtaacaatggtattcccacctatttaaacttatattgactcaaactaggaatcttttccaagggcaatattggagggaattccacaacctactagttgaagttgacaatgtaaaacaatctttttttgaaaaatgagaaaaagatataatcaatgtcacatggagcctattttgaacttacaaaaggagtgccaattagcattggaaatgggcaggggggggggtgggctgggccacacccttactcgagcttggcccaatttgttttgggcttcaagccgagcttagcttgaaaaatttttggaaaatgcaggctcaagcatggcccgagcctgacccaagcctaatctaaatttgatcgcgccaacttaagtttgtagaagggactgtagtttatggaatgatcacaaacagctttctcatatataattcagaattctaatcattttaacatatcttgaatcacatcgaacaattatacctttagaggattctatagaagtttgtaaacatcaatatttaataattgtgagcacaaggatttaaagaagaatcatgaaggatttaagatttgttcgagcatatgcattcagtctccattccagaccttggtttggcttgggcttggactcaagtcgggccaataatatacctgagctcgattcgaaaaataaatatgctccctatatttaagccccaacttagtctaaattcttttgaacctagcctatacgtagtctggtctaaagttagcctggctcaaacccatttctacccctagaaccaatcataagactcaaaacctattaaccaaagtcaccaatatgaaacaatcttgttttcaaaaatgacagaaatcattagcagtgtcatggacattggaagctttccttttttattctattatcttttcaaccctctaagaataatggtggcattccagctatttaaacctattcctatttgagctcaaaatattttagccaaatttgacaatgtaaagcaatatttttttttcttgaaaaatgacaaaagttattatccatgtcatttggagtttgttctgattctagcttggaatttttctcaagtgcaatgttaaaggaggatgccaaccattagaatcaaaatttattagccaaagtcgccaatttgaaacaatcttgactttttgtaaaaatgatagaaaccataaataaaagattttttaattcttgtttccttttttaaccccttcagaataataccggtactataccacctatctaaacctattatactttgagtttggatctattccaaacataataattgaggacgggcatcaaccactatactgaaaatctattaaccaaaataaatatttctttttgatgttatcaaactcaccaattaaacacaatctcttttccaaaaaacaataaaattcattatcttaaaccgaaacttttccttttcttccttgcttgataattaaatcatttatatctgaccaaccaccaaacctaaaacgtattaccaacctcaccaattcaaacattctcttttctgaaaaatgacaagagccataatcttgcgttgaaactttccttctttttccctaccaataattgaatcatttatattggaagatgcactacatttcaaccatagattttgtattatacactcttttaattcttttgatccactacagcaatctgatgtcgatcctaaatcctaaaccctatcctattggcttgcaaatgcaacagatgcatcacgtataatttattcttatcgtattatgtttactacttagcagaattgaccacacatgcatggtccctccttatctagtttttgttgtgttatgttaaaaacttgacaaaaataatttttttaaaaaaatgagtttatgaaatgatctattttaatatttaataactttttatcgacttattttattatttagtttgatatattaaataattttatcttgaaagaaatcattaaaactaatagcaagagtagcaacaacagcactgaactcactatggtgctaaaagaaaaaaattatcataaaacttaatagtatgtaacatgggagtgtctttaaatgcaattttgtaatgtttggagttttgtagccttctttcattgcacaatagatccttgtggttagacaaatagaatctctcacttccaaagcaattttgttccttttctttcatgtaataaccttcattttcgtttatttgattttattttattatatgttttggtatggcaatagattttaaaataagtcccttagttggtttgcgcaaaactttgaggcccttgattttatttttcctttccaaatagggagagatgggatagagaaagagatattgcccgagatttcctccttaaagtatttgttctctctgtttttgtcttattactcagtgttagagcccccttctctctctaagcctagagttaaacatttggaacacaaagcaaaccgatcattgtatgctgacaacctgcaaccacccagtagcctttctcagaacacaataaataatttaaaccaaaagtaaggggaaaataaaatatgttgtcttgatttttatctcattgttatctttccaaaatttgttttgatttttatgtaataatgcattagagtgtatatccaaaaaaaggtggcagtgtatgaggtgtgcaaggtgataatgcatgcacttggcctcgtgcgaccgtccgcgggccttcgcttggcacggcattttctattttaggtggggattagagtctatataagccaaaggggtgaggggtgtcggagtgtgccaaatcatctgaggttgagttcttggtaggattctgaggaaggcttgagaggttcgcaactttgttgccatggagtttcagggaaatagggtgagtgatcttcggttgttttcttctccttcttgttgcagaggcacacatagagacacatatacagagagagggggagggagggggagaaagcaagctcttctattgctttcttctcctcgttgcacagggacacacacagacacccagagagagagagagttctcacccagagagttctctctctctctctctcttctcgaaaagagtctttcttcttgagtccacactgtgttaattttggtttatctgcatctgttctccctcggtctcttctgttgatagagatggagagatggtataatcttcttttaacagctctctcatctctnnnnnnnnnnnnnnnnnnnntgcatctcgttntcctcggtctcttctgttgatagagatggagagatggtataatcttcttttaactagctctctcatctctctctctctctctctctctctctcgaaaaagagcctttcttcttcagtccacagtgtgttaattttggtttatttgcagctgttctccctcagtctcttttgatgatatagatggagagatgccataatctttcttctaacagccctttcatggtagatttctacttttattgtgtgggtggtttttatcttaagtccacatagagtggatctttaattattgtgtgtgaattctggtccatcttcatctgccttggtcacttctaatgatagagagggagagatgccacaatctttcttcttccagctctctcatggtagatttgtacgtttagtgtctggatgatttccttctccagtccacatagagcgaccttttttttgtgtgaattttggtttatcttcatctattctcccttggtcacagctgctgatgacagagagtgatagatgccgtatagtctttcttcttatagctctctcatgatagatttttactttcattacacgataattttcttcttcagtccacatagagtattgggcgaattttggtctatatttatatgttctcccttggtcacttctgatgacagagatagagagatgccatagcctttcttcttacagctctcttggtgtagctattttttcttttttagtctagcgatactttcttgtttcattcctttttttttttttttatcttttctcttttactttaactgatcttttttatattacaaatatgcattttcggtgtcctttttgatagatctgtattaacatatatcaaaattgtttgtgtttaattatcttctctcatagattttcaattaaagttaccattatttcctcattctcctaatcatgctttgtcttttgtgttacaaaagaacatgtttcatgatcaagcgcgggctcatcagcaaaatcatgatccacagtctttccagatcactacggggatcgaggctcccagactggtcgacgaggaggaccattctgccaacccgcaaactgaagtccctgcaaacgcctccactggggaagatgatcaacaacggagggctgctcccaaaaggaagaagtaccagagacacacacctgagcaaatcaaagagctggaagcgtataatatccccgaaggaccttccctacttgaaaattagattattatttggatcagatcaatttctttaattatttttgtcactttttcccatcgtattttttgtttttttcgtatctcatcttttatcatttctagaaaggcattattttttctttcctttttttttttgtcttttacagtcttttcaggatatgcccgcatcctgacgacaagcagcggagagagctgagcgagaaagtgggcatggagcaacagcaagtgaagttctggtttcagaatagacgcacccagtctaaggtcaacaacttttcctaaacccctcctctctctctctatctcttctctacacgtcagccacttaccacatttcccagctgacgtcacatttaacatgcatccactgcactttatttactattttttctcgactgggctgttgctgccgttactacttacccaccgatgttttatgtgtcccctcttattgacggcaacttctatatttaccatcccccctccctttctctatatatctcctattcttcgaatcatctaaccctttcacagaaccaccgagagcgcgacgacaacaagaagctccgaaaggaaaatgatgagctgcgcctggagaacctgaggatcaaagaggcattaagtaatccatgctgccagcactgtggcggtccttgcgttattggcaagatgtccatggacgggcgccgactgaggttggagaacgctagcttgcaggcagaggtactctcttgagagcttcggtgttcgttttatgtacgtgcgtagtttatatatatacatacgatgttctgctatacttcttggatttttgtagattgaaaaggtgtcggtgtggatctcgaagcatgggaatcaatcagagatgccgtcgaccgcgctgcccgagccggaaccctcgcatcaactagtggtctctggggtcgttactggcactgtgaaggttcctctgaatacgatggaagcagagagttcgagagcagcggaactgcgcgggccatctgttaccgtgcaatctcaggctcaggtgcagaggcctttcttcgaaaaccttgcagccgtggccatggaggagctaatggtgatggctcacgctggtgagcctctgtggatccctggcctcgatggttattatgagattcttaacgaggatgaatacgcccgagctttcccgagggggctcgggccgaagcgactcgcccttcggacggaggtgactagaggaacgacaataatgtttacgactccgctgttccttgtggacattatcatgaatgtagtgggtgaaagaaaatttattacggctttgaaggcagaaaatttttttattatatgccactgcatgcaacggttatgatttttattcttctctatttttggcagagcaagtggtcgactttcttttcaggcattgtttcaagtgctgattatttggagatgcctttcattagcatcggctccgagggaatgttgcaattagtatggcctctatttttttggctcttagcattctacccataatttattaaaatcgctccagattattatggttttggtgattgcgatataatcagtgaaattttctttttccaaaatggaaatatcattctggtctatacttaattatttcatgggaccaaaatctaattttatacatcctcagatcacagcggagtttcaagttccatcacctctcgtaccacccagagggtgtgtgtttctgaggtactgcagaaagcatgcagagggattctgggtaatcgtcgatgtttcaatgaacaaccatgataactcagaaatcagataccggagaaggccatcgggctgcttaatccaagagatgtcgaatggctactcaaaggtaatgcagtaaagaaaagcaaaaaaaaatcgattcccttctactctatctaccgagcttccctagtaattagttgatttattatcttacactaatcgttatcgcctcagattacatgggtcgaacatgtcgaagtggatgattctggtgttcatgacatgtacaaggctgtagtcagttcaggtctagccttcggagccaaacggtggctgtcaactctggaacgacagtgtgagcgcctggcaagtatctcggccattaacaatccgcgctttggtcttaatggtaataatcctccacttcttccaagtaaaatccaacaacaatatagttccatctctctcctaacctattcatttcgtattctgcgacagctaaccctgagggtaggaagaacattttgaggttggtggagaggatggtggtaggcttctgcggtggggtaagtggatcaagagctcagggctggagccatatatctggaatcggtgcggaggatgtgaaaattacagctaaaaggaacactgttgttactggttcgcctccaggaatcaccataaatgccagcacgtccctatggctccccttgccgccggggagaatttttcatttcctgcgcacctcacgcaatctggtgttcagggccccttcgatagtgcgtcctctattccccttgccttccctttactgctttcgactataattccttttgctcttatggcaagaacgtttaatgattgatcatattcattgaatcattttagtcatagtggcttaaaatattattttgtaccggacccttaccttgtatttcctatgtttatctcatttcgttgattacttactgcattgattgtattgcaacgatattgcaacggtctgatgaagagttataaaagtaaatgtaaaaaaaactcctcagttatttgtgagaatgccggataaattattcaagcaacgtttcatctcattagcgattataggggattagtttattgtccagtgttattcatcattttattttctttaattatatcatgacaattctaatattttaagtattttgagcaagtacttctaaaattctcgctgtgattgttagaattgggcgttttcattggtgtattgcattttaatgctctaaatgaattagcaaactaagttagtttcaccagccaagatttccaaaataaataatttcatgagataatattgtaaaatttggagatcttaatccgttccacagaaggacctgatcttttatttcatccatacctgtattccaagttgcagattcaactttcgagaggctcatgcttgttttccatctaccaagctattgttgatttgtgtggatccgtcatgttttttctttttagatgagaaaagtaaaacaaagactatttgtggaactacaaatttgtttcttaaatgaaacaaaaattattcttcattatggtcgagtattctaaggtttcataaaaatatacttattatgggctgtttcacttccatcaaaatatattagagtccatgcatgtacatgatttaatatttaaacccactgagagcatatatccttctacctactataaattttttattttactaaaataattaaacataaggcttgtccatacatattcaaacataagttcatgttgacatccagtttatgcatttatctgattagatgaattcaacctgaaaggattaatgcaatggcaagtgtctgttttcctttttcagaagaagagtataataaaagtcaaccacaaattcaggcactcataattaaaagtccatgtctacgtttatatatacacatggactgggtgctttgttctccaaatgatcaacgtctatttatagcccatttattacttctataaatgatatttaatgataataaatccatccattataaggcaatcttgatatacatctcctttctaagaatttattgagatgctcaaaaatgaaattgaagcactaacttagataatgatatttgcctcacttgcgcttgggatgtcagtgggacgtgctcgcgaatggtgctacaattgaagaagcgtgccaaatagctaatggcagggaagaaggaaattgtatctcgatactcaatgttcgcgtaagcttaataccatttcctatcatcactgttttctagctccactttcttttcatcaatacaacgtacatctctctctctctctcacgtaaaaaacttaacttactctacgttgcatgatggggagtgtagggaccggaaagcccgagccacgtgatgatactccaagagaactgctcccatgcaactggctcgtatgtgatctatgctccaatcgatgtcgtggcgctgaatgctatcctgaccggccaagaggcagactacgtggcacttcttccttgtggatttaccatattccctgacttgccttatggcatgcaagatggcttagttggtgagggtggctccggaggatccctcttgactgtttcttttcagatcctggtcgactccaatccagattcaaatatctctgctgacaccatcgccaacctgaatgtgcttgtgaccggtacctgcgaccaaatcaaaggttctctgttggctaaaaatgccccgtgaagctgaaggaggtactcacataagttgatctttccagaaactcaagtcttctttgggtgttaaaacatcatctatagcttccttgttctgttgaaaaaaacagagttttttatgtttaaggaattttaagataccttttttaatgaattatttcaagaacgaggtctgcttgcttaggttttgaggattttttttttttaatttaagatagtagtgaaatttctgatataaagtttttcctcttatttttcttttagcttttcctgatttcctatttttacttatccatctatttctcttttctgttcctaaaaaaatttgttagtattttagtacatcatacaactatatatccactctcccctattcctttacatcttttgtaagatacatcagcagataactagttaaagtccaacttctaccttatatttctggcggacaggaggacaggagagttgaaacggaagtcaaaaacgcacctcagactctccaagacatgctagtgtgctggttcgggcattgaattaaataaagtacctgctagattagcagaccctcctatatgatatttttctgttttctttctttctgcaccttatgtgcaaccttgtttggttcttgtaataataactatggtggatagagatatctaatccacattgcaacatttctcccttttactaaaaacattgaggatgctctttttaataaagttaaacagcttatagtatggttaattagcctgcatggttctgttcaaattgttgtgttgtggatggactgtctactaatgtcgtaattgtagctatggaattgtgataagaaatgctagtatggctgcataaaccatatacgatatggatggaagatagggaacggagggagggagggggctatatatatatatnnnnnnnnnnnnnnnnnnnnagcatggttaaatggtcttgctgatgttgccaaaggattttatatataaggactcgtacgaatatatagttaattctacattagttatgcactaaataaatcttgaatattcaaagaaaactaaaaaattaaataatatcttctagctaatttttttatataaaatcctagattattataaattgtatcagagcagatccagcccataatccatatatatatatatgaactaagggatcctgcaatatgatctcatttggattgaccatagagtcatcatagcatttataattgtatctgcagtacttgtcatcaagttttaactttattattagcttccatataattttaaagtccttagcttcaaaatttttctaaactttgtcaagtccacgaaacacactacaagaaaagagtgtttttgcaatagaattatttacgacgaaaatattttcgttatcaataagagtatttacgataaaaattataaataataaaatatttatgatgaaaataattttttgtcacaaatagtttgctattagtgatggaaaaaaattccatcataaatactcattatttgcaacgaatattttcatcataaatattataatatatattttaatttttaatttttaaatatttataataaaaatatttgtattataaataatttaattatttatgatgaaaaatattttttcatcgacaataaaattattttcaatgaaaatatttcatcgctaatatttgaaaaaaaaattaaaattaaaaatttatagattatttatgatgaaaatgttacgtcataaataattaaatatttatgataaaaaaaatttcatcataaatactcattatttattataaaaaatttatcatgaatattttaaaaaattaaattaaaaaattatagattatttgtgatgaaaatgttacatcataaataattgaatatttatgatgaaaaatattttttatcataaatactcattatttatgataaaaaattttcatcatgaatatttaaaaaaaatatttaaaatttaaaaatacagattatctatgataaaaatattacattgtaaataatttagtatttgtgataaaaaatnttttcatcataaatagtctattatttatgatgataaattttcatcatcaatatttcaaaaaaataaaaaatttaaaaattataaaaattataaattatttatgatgaaaatattacctcataaataacatagtattcacaatgaaaaatattttttcatcataaatagaatattatttatgatgaaaatactttcatcgtcaatatttcaaaaaaataaaaaatttaaaataatataaaaattagagattatttgtgataaaaatattacatcataaataacatagtgtttatgatgaaaaatattttttaattataaatataatattatttaaaataaaaatatttttattatcaatattttaaaaaaataaaaatttaaaaaacataaaaattaaagattatttatgatgaaaatattacatcataaataatttaatatttatgataaataatttagcatttacatcataaatagtagttatttacaatgaaaatatttttattgccaatattttgaaaaaaataaaaatttaaaaatataaaaattatagattatttacgataaaaatattacatcataaataacttagtgttaatgataaaaaattattttttatcataaatagttaattatttatgatgaaaatattttcatcatcaatatttaaaaaaatataaaaattataaaaattataaaaatatatattatttataataaaaatattacatcataaataattgattatttatgataaaaaataattgattacttatgatgaaaatatttttatcgtcaatattttgaaaaaaaattagaaatttaaaaaatataaaaaactatggattatttacgatgaaaatatttcatcattaataatttagtgtttgtgatgaaaaatattttttcatcataaatagtctattatttgcgataaaaaaattttatagctaatattttaaaatttaaaaaatataaaaattattgattatttttgataaaaatattacatcataaataattgactatttatgatgaaaaattattttttatcataaatactcaattatttaggataaaaatattttcatcgtaagtattttgaaaaaaataaaaaatataaaaaattataaaaattataaaaataattaaaaaatcaaaaatttaaaaaaataactttcgatattgaaaagaaatcattctcccagtatccagattttgttggatgatacaacaaaattttgcacctacaactaaatcaaccgtctataggatttaggagcaaaccacctcagaaaattaaatgcaaggaatttaattcagaaaaaatatcgacttccaactgtataaagaataaaactttatcaactgttcgatggactaaattgtatcatttacttctaaaccatctcaaaaaaatttagccaataatctcttgtgacaacaaaatcttataacatcttcaatagaaaaacataacttcttaaatgctgtccttaatctatggcagataatgcactacattagcccgatctctggaaccatcaattgatatcgatcctccattagaaagatcaaattttatataaaaactaaggccagcagatcacctaaaaattgatccaaacaaggtatctgtgaaaatataagaacacgatcaaaatttaactcatatgtaataaaaattattaattaatatctgcaatgtatcagcagaaaaatgattatcatccaatagtacatgataatgtattggtttgctggtcccctgaatgaaaacaaaatatagataaattgataaaaaaatattttaaaaactagataaaactagattatgcaaatacttaaaactaagaagattacatgtaaaaaccagttcatcaattgccactcatcattagaggatagaaaagatagagattagatccctcctaacctagaaaaataaaataatgagaaaaaaaatataaaaaaatattatctttataccagcatggctgtaaagatagaaatcaaattctatcagatgacaaatcattgtgtcgatcccagttcctaatcatatgaaaaatatcattgaattttcaagacatttaattgatcaaccctaacaaaaccatatgaagatcaactaggctctttaacatgttttaaatccacaaaagcatgcattaaaaaggataaccaagctgcttttttatgtatgtaattttttttgaagaaaaaattataaattagctatttatatatattttttattaataaaaaattaaattttttgatgaaattattttgaattttttttttaaactaaaaattttttagattaaagaaaattaatttttttggatgaaatttttttagaaaaaaaaattttagtggaaaaaatttttttggtaggaattattgacgataaaaattaaattttcattactaataatattattaatgacgaaatatgtctctttcgttgcaaataaatttattttatttttttagtagaaattttttttttgatgagaattattgacaataaaaatcaaatttttgttgctaataaatttactaaccatgaaattttttttcattgctaataatttttttgagcaaaattttttttagcaaaaattttttttagtaattttttttatatttttgtgaaaattattgacaataaaaataaaatttttattgctaataatgttattaatgatgaatttttttcatcgtaaataattttttttaaagaaaaaaatttttttagtgaaaaatttttttttgatagaaattattgatgataaaaataatttttcatcgctaataattgtattannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattggtatatacgtacaaaaaataatacctagagacgtatataacataccaacccgattagagatagataaaaattcggatttacatgaaaaggaagcttttcagcaaaaagaataaacattagcggagcttcttattgatgaagaacttgtaatggctcttttgaataggactgatctaccatcctacaaagttgaagctgattttgtatttaatcttgatgagtcagagagcgacgatcagttcataaatgatgatgagatagaagacgacgcatatgtcgattattatgattcagaagaggatctacacatcgagtagatatgaatattgttgagtagatctatattctttgctcaatcttctcttgcaataatggtatacgatataattctattcattaaaatataatttatttattattattattattcaatattatattcatttatacgtcaaaaattgtaggtatggcatcaggagacagatgacgatgttcgcgttcgctatctcccccagagactgaggtgccttcaccaatttctactaccacaccagctccgttgctagagatttctgcattggcaagtcccaatgagacgggttcgagtgagacgagtccgagtgatattattatactttttatataataaaatttaatttttttatttggatgctatcatactaatgatttatttattgttatttcaagtcaatctccaccagtggtgaggtgagggtaaggtccatcgaagaactttgctctaaagcgttggagacgcgagcacccaggaaagcgtctctatatcgagataccattcggctacaccagacccattagaggatggtgcgaaccgtggcaggccgagctggacatcatatgtcgttgctatgcccctgtgatgcttttcaattggtgtcatgttgtaccggctcaaagaaaaattttctacatccagttacagataaaataaattatatcatgaatatttaattagcatggtattcttctaatatctattattgacaggatgtttttgatattattgattttgaggaaaatcatgtgcggtgagctgtagacactgatttatctttgcatttcaaagactatcaccacaacatccatcagcattggtatcatgtgatgcaggatcatggggtggaggcagtgacagcggccttataacagcatcactatggatgattggactatcatatactggcattacgaggatccgacatatcaggttacacattcaaacttttttttaaagtttaatgattgaatcatttattcttaaattcagtttgttacctactaatttgactgctaactatatagagaagatgtgtccagaacgtcgcgaatcggactagacagaccgtactgcattatgagggttcgaagtcgttcgctcgttacatagagtagatggtaagtaatttctaattagtatataattctctagctatttaaaaaaattttaattaattgttctcaaattgcagagagatgctgagagtggcgagctttctgataggatcgatatccaccagcggacccactagtgacggtcaggagagtggacgacggggagccaggagctctttgtaaatttttttaattattttttcattcacaatttgattttcaatacaaaattaaaatagttataactttaattttcaggaccatatgatagacatcagatcccagcctacctctgagggctcgaccgcaccaacagataatgagatctatgatcagatgcttggtacatgaccctgttatgttaggagtctagggcatgggattactactttctcatcctcatgctagtccaggaccgacatccatattgcctacgatgctcgactggcggaggtgcagaggcaggttaagtagcgagctgatgagttgactgcacgcgtcgacgagtaccagtgactccagatccagatgatggagcagatggtgcagatggagcaaatgatgcagctgatgaggcagcagcaggccggtccgagctcatctgagcgctcctctttttcagccagttctccttctgttgatgctgacacttgacggcatatttgtgcagctttttatttttattttagtcctcttgtaattttaatttaatataataaaatgataaaatttatttatgaatttattatgtaatttttttatttttatttttattttttaatttataaaaaatattataaatataaattaaatatatatatattcataaattatttttaaaaaaattataaattattagcgatagaattattttcgatgaaatattgatagcgaaaaaaatatattagcgatgaaaaattgatcataaattaattttttaataaatttaaaaataataaaattttatattaaattaatagcgacaaaaatatataccagaatttgaaatatttgagatgtaaaatttacatcgctaatattttttaaatttgatttttataaaaaattttaattaaattaatagcaacgaaaatagtttcatcgtaaataactatatttgtgataaaaaaatttacgtcactaatatttttttaaatttaatttttataaaaatttttaattaaattaatagtgaaaaaaatattttcatcgtaaataaccatatttatgatgaaaaatttatgtttctaattttttttaaatttaattttcataaaaatttttatttaaattaatagcgacgaaaatagtttcctcggtattaatttaatatttattagcaacaaaattttttgtcgaaaattactatattggcaacgaaaaatttatgtcgctaatatttttttaaatttatttttataaaaatttttaataaaattaatagagacgaataaaattcattgcaaataattaattttgtcacaaattatctttttttacgattaaaattttttctcgtaaataattttcaaaaaaataaattttttgacgataaaaatttttcatcaataatatttattatttgtgataaaaaaaattttcatcgtaaaaaattatcaacgatggtattatttgtgactaaatgttagtgacaaaattttcatcgctaataactattagcgatgaaaatcgattattagcgatgaattttttttatcgttaatattttattttattatagtgtacactggatcagttgccactatctctattatggcatacgagccatttgatatttcaaacaataatcatatcctgtacataatcaatcccaaccatttgaaaatcaaaagctttatattcttcttgctaacctgtgaacaactagtacaatagaaatcatgaaaatcaaataatgtaagacagtcatctatatttttcaccatccaaccatgatcgaaaggttcatatctttctctgtcttggttagtgaagccatcaatcaatgcagttaatctggaccatacatactcccaaaatagtgaatcttcttgatcatcaacaaacctttgatgcagtacgtacataccatttatctttatcgtgatttacctgtgaagctaaaccatgcatctatatcttgcacatgaacctgttcttctacgtacatttcttatcaattggctgatcacaaataaaatctcgttgtgtgtcaataatactaaaattaaaaaaaattatgagtttgtatttccttactatttgatgtccatgcaccaatatcatataattcgataactttctctaaatcttcgggtactagtaatgcaacctccaaattactgactgtcacacagtttctttcaattaaatcttcataccttttccttgcgtaggctattaatggaggcactttgatcttcaatattataaattctgaatgatctgcatgaataaaattttctattctaacctcgttgttagctttttccacggaaacaacatcctcaatatatatatgcatcacatatggaatcaaattcaccattaaaatcaataaagatagaagaaataatagatatttttcatcgtcatgtgcttttatcatcactttctatggtcctttggttgcaactatgaccatgacttgatttggtttcttttggtccttctttggcatcatcatatatttcctccaaaagatcccgagcttccttaactgatcttgttgttaatgttttctccaaaatcacttcatctactgcttgacatatagatgaaggccaaattaaagctaagtatcattcttgtggtctcctttcagcgccttctttcgtgcatgagggagcttctcaaactctacttcttctcaaactctacttcatttcggtggccgctaccattgcagcctccattcttgtcgtcttttacctggccaatctcgccggccccaagaaaaaaccctgctttgctgtgatagcctggatctcctctgtcgccactagtgagaagatctatctctaagacggtgttgtatgtatctccattgttgttgccccttctatcttcttctctcttcttttcttctcctcctccccctcaactcatcatcactaacctatgatcctccccctgctaagggttgccgtgacccgacatgcttttagatttttcttagcccatatccctcgttgggggcctaagttaggcaaaggtgcctcctttggacatctatcttgccagatctccagttattttaacatattttcttctatttttaggtcagaatttctattcctagtcagctgtgtaagtctcatctatataacacagactagggttttgtatgggcaaacttgaatttgattaataaaatcttcatgcagtagtttcttccacctttatccctcttgttcttgtgcttcacttcctcctcagcttgcggtcgcgtcgcgtctgcattggtattttttacctccagtttccagcatgttctttcgatctaaattttttttttctatattttttcatattattttctgtatcatttgttaatcgttaagctataatggaaacttgctcaaaaatgtcttgacaggaatccatccgtcctcagaattctaaacgggaaaactactccagaagaccaacataaccatggcatgtgccatttagcccatgatatggctgtgtgtgtgacgtttggttcagatgggtctggtccgaccagggcttgaaccgttagctagcgtcctgagcggacctattcctatccgactaatggataacccccaggaagccaaaacgattgaaccattgactctttgcgcaacacaacagtagatgtgagaaattcttcgtacaccacggatggtatagaattacgtgcactatttgtggtgattggctcgtgtgtgggatcaaaaaaaaaaaaattcatacaccatgccccaactttgcacgtgagctaattaccgtaaatgctgtgcactttctgtactgtccgtggtacacaaagaatttctcgagtagaggtatgatatgaacccgagccagacatgctttggtccttacgatagctacgttaggacttgggctgggtttcttcaggtccgtgcttgaactcatggaacatgggctctgtcgatttgggcttccagaggaaacatgcgttcaactactcgcagatagtgttgattgaattttttatttctcatagctattttgttggatgttgaggattatcaacttgtttttttattcttttaatgacatggattaattagtccactggattaattcatatattcagcatagtctctttcggatgtaaaaaaagagaacaagatttccgaaatatgattctacaaaattgttggccatttttcatttttgttcaataataagtagaaaaaagttagtttcttataattatccatggtaagaaaaaaagttagatgatgttattcattattgtcaaaataaggtggttttgatattacaatgtatgcaataaatagtttacttattacatgctatcttcaccatttatataatctttcatgagttatgactttcctgccatttcataggctgtttctactagagcaaggacaatgtataacttggagcatattgctttaaggtttgcttgatcactttcatttttgatgtgaggttaatctccatacctcttcttattcattttaatgactgaattttagtaattaactttactaatttctttctatcaatttggtcatatatgataaataccaagcaaaataatcacacaaagttcatagttctcatgcgtacatgtaaatgagtaaatttcaactagtatttaaattcacttgcacacgctatatattcataatcattttttttaatgaaaatattcataatcatattaattaacatccttggaggaagtccttgaagaaaataagtgaacactacctaacttcccatgaactcttcgtagctagggttttctatgcttaagctttccatataacttctttgactcttgaagtgcatttgatttgtgatcaaaattgtaatcaaaattgaaattagaatgaatttaaatagaagtcaagatggtcatattcctcaatatattttgtttgcgatcgaaatcaaaatagaatttgaatatggattggattttgaagaattgggacattcctattcttcttttaaagtccaaataggaatgaaatttctctcaactatgcccatttcagagtccaactcaccctcgaaccaaatatgccgttggttcgattagatatttgaggccaaatattgtgtgttgtagattccccggttgggtttgaccattccaatgcactggttccagcttgattccgattgggcttcagcacccaagctggacccaactgtcaaaaagtgatggccgcattcagtgccccatattgccaccagggaatacgtccaaagtggcgaggccaccctattggaagccggtccttgatcagaggtcacaaggaaacatatcacgataacgcagcagacagccatttccacgcgcagaatcgttgcacacaggtaaaatgtgaggtgtaaagcactagaataagctgtttgctgtctctcgccacatatcaagtaaacccatcataagaaacccgtgaataattgagaacgtccgaatctcgtggaccatgcggcggtcccgtgacagcacgtgacgtttgttcctcacgtctccggagaaagcagagccgttcctccttcccgcgaggcccaacgtgtttggtggtgaaccgacccgagtaggatacaaacaaaacgagagatcggtgggatctcgtcacctaccccggcggtgacaggtcgtcacgtgctctgctcgtcgtctcccgacctcgccttcaacgttggagactgcatgcctccaaacttggcttccgggctaccgttgatgttgctgttggccatttctaggactgtttctcggaatctccttaattttttttctcaatcattcagccttggaagaaggcctctcctgttttgattctttcaccattgttagctgttatttggttgtttgtggttccctcctagacaaagtcacttgggctaataggacaaattaatgtgcagggccatctatgtctccaatttcacatgaagagatctccatgagtgaataaaagaacaggaagatgaggattgtgcatgcaaagtctggtgcaagccttgcatcaaaagatttcttccatatttgattacacttctgtaattagaaagagaaggtgatgaattaactaattgttagatataaggctaacatattgggacttcaaaattgaaagttatgaattatgttggtagaattatcatcaaaaacgaattatgttggtataatgtgttgctttttaattatgaagagggggaagatgagttcaaccatagtccaagctaacgtgtcatatacttgaagtgcagagagcacagactagacgggggagaaggaaaatcctaaacattgaaaataatatgtttataacataaggtggctgtcgaattagtaaccaaatataataaatggatcttaatgtttatagaatatagatttgcataagatataccagtgtttttatacagcctagtcaataagaaagcccgcttccattacatatgctagcacaaagccctagtgaagaatacataacttgagcatgtcgcaattgagattgattattagattcttaaagctattatattggctaaatctcatcccatatatcgaaatgtgaggctggtagaagtaaaataagtatttcaaagatatgcgaagttgcgaatttagcttgatgcgatggtaacatccatctacatagcattcaaatgttttgcatttggttcttagatcatacatatctaaaaatataaacttgagtaacaatagtgtaggatagcatgttcaaaacatatggtcatataattaaatattcacttgcaatagtcactatggagaagagttagtattttatatctattgtatcaaaaatatagaaatgatatcatacgtagcctcttgtgtaaacatgctaacatttctttttggtgttcttaaggtattgctttgtccaacaaatgtattcataactgtcatgcttatttaaattcttgtcatggatttcatccatcatttatcaccatttgctacttgcacatagcgatgtatctaagaaatttaatatttgatagagtgatgccatacatgaatagataaattatgtttaggcagctacgtagagatccatgtataaatattttatatgtcacatctttttgataaaacatatgccacacttttaacatatcatcaattatatactaattaaagcaacctttgcttattattagctaagcattcttgagaacaggtttaatatattaaaaaataaaacattatttttaatacaaaaattgtatcatattgctgttttttcctcaccaaacttccaaagaatattccccaagcataggaagtccattgctaagattctgtgtacactaaccctccctttccgcttataaataccccttgcttttatagttcgaagatcaattcagcgtagatttttcctcctccgaacgcagagatcggcgattcatactaagaattctatatatacccattccttttcctcagctcgaagaactcacaaaaattagtgctctcctcaaaacttcgtccggctcggaggaaattcttgtaatctcccctgtttctatttcccacccggttccaacctcgccgagggtcttttctaagcccttcggccactccaatcccaaagtcctgcttcttgatcacttctggcctccatctcgatcggcaaaatgatttgctcaacgaggtattcaccggcggtcttcgccctcatgctctccaaatccccatctctccggccgcgaccttcctctgttcttcctccaatctcctcttccacctccgagaacctcaattccgcccgttcttccattaaacctctttacctcacccctagctttggcttcggatcccgcgatggatccgtccctgccgccgagcctcgcggcctctccttcaaacgcacggcctacgaggccaacagtgcggagggcattgctctcccgagcgaggaggcgcgctcggcggcggcccagaagctcaagattgggatctacttcgccacctggtgggctctcaacgttgtgttcaacatctacaacaagaaggtcctcaacgccttcccctacccctggcttacctccaccctctccctcgccgccggctcgctcatgatgctcatctcctgggcctcgcgagtcgccgaagcccccaagatcgatctcgatttcttgaaagccctcgcgccggtgagaaaattagcatctttgttacgcttccagggttttgggacagttttgtttggctctgtgattaaagttctctttttggctcgattaggtggcggtggcgcatacgattggacatgtggcggcgacagtgagcatgtcgaaggtggcggtgtcgttcactcacataatcaagagcggagagccagcattcagtgttttggtgtcgaggtttttgttaggggagacgttccccgtgcccgtgtatttgtcgttggtaccgatcatcggcggttgtgctctggcggcggtgacggagctcaattttaacatgactggtaagaagtgctttaagagatgttcttgtctgatatgaagtttaagtgtcaaaattggttttgtggatcttggagttgctctgttgtaatgtcagagttcgtatgagctttgttgctaattaattgttgataatggtcttctgatatcatcttcgtgttttttttctttttagataaacataaaatttaaagtaacattttgctgaagttggtgctctctgtcattatggttcgcttgtgccttattactgctgtttactttttgaagtacctccaaatgaagtgctgtttcaagaatttaatagaaaaaattatcagattaatgtcaaggtgcccaagatgggttttgtggaattgttgtttcagaaattatgacttgttctgtttttttttttttgagtaaattatgactcgttttgttgttcttggtcattttggaagttacttttgcctttttggtaatattggatatctcatatatcaaaatattgagaattactggtaatattttcgaaacctctgtttgaactgaaattgaatcagatttgaaacttgggattgcgagaataatcatgatttggtgcgtcgcctttgcatatggaatattgaaattttcgcctattctttcatgcctgccatttttagagtcctttttattatcttgcctttctaatagtttacttcgttgtgctaaatagtgtcagctcaataacatcctaagcatctcaaaatcttagatcactactatgagcattttccaattgcttatatacctttcagtatagtttaccttgaatttgatggttgagatgtttgttttcattgcaggttttatgggtgcaatgatatcaaaccttgcttttgttttccggaatatattctcaaaaagagggatgaaggggaagtcagttagtgggatgaactattatgcctgtctgtcaattctgtctctgttgatactcacgccatttgcaattgctgtggagggcccgcagatgtgggctgctggttggcaggaagcttgctctcagattggtccccagttcgtctggtagaaacagtgcctttagatcccttctatgtagatatgttctattgctgttatgttagtaatttaagcacccacagttatcatctagatgtagtctccctttatgaagccacttcgccatggacttttaagatgcttgggactaattaaccccatgttctcaaaatatttttgcttttctgaaaaaagaaagactaattacttgttttatagacgcagaatccatttacctagccacttcattacagacttttaagatgcatggactttggttgtctgaaacagaaaagatgattttttttagatagttttatgaatcctttttataggacttatagttcattcaggaaattggaagattccaatcagtgcttctatcttttcttggatgatctgttactctttacacgcgcacgcgcgcgcacacaccaagggagcaaaggtactggtgatttcgggatcttctgtatttttttttcttgttggtatatggacttgggaaaaggcatcataatttttagtaaaacagggttgtataagggcatcatatggcaagtcaaatttgcaagttactctgaattctgatttcttatcagtcaaacctttgttatttcttatcttaaaattgtaaacatttgatattgtttttgttcgctgattatgtgtaggttggaatatactatttctacacttgacttcagaattctacaagtgatatgcttattgcatgttttttctgactattgttttacctgatcgagtttgtctatttggctgttgtatcatatttgtataggtgggtagcagctcagagcatcttctaccacctgtataaccaggtctcctacatgtcgctagatgaaatttctcccttgacatttagcattggtaacacaatgaagcggatatccgtgattgtctcttccatcataattttccatactcctatccaacccatcaatgcccttggagctgccatcgccatccttggaactttcctttattctcaggtaatttctttttgaaatgtatggttgtattgtattgcgcagaacataaggctgtgattggatggcaatagagcttgtgctttcatttcttcatattttctaaagactttgagatgtccgcatgtacaatgtagcatagcaaagaaaaggtaggatcctatcgttttttattgaggtaccttgacagtatgaatatcacacttgttgccaactgaaattacagacctggctgcccttttagtatgattgagatacggggtttcagtgagtataagtcagccaaatacatatgcaaaagttgcttaatgtcctctaggaggtgataactccaaatattttgttatacactcaattctaatccgaatatgccacacaaaccttcattttttttttcgagcattgtgctacacaaactttatcgagtagcaagaagatcacaagaaaatgactacttgatatgaacagtagcaacaatcaaaggcagattgaattggaaatttgtcaccaaccagtaattttggttatgtagcctatgattttattcacaagcatcttagattaacttagatgtgtgctgtagaactttgatagctcactaatttttcttaaatggttatgcaggctaagcagtgaaagcttctactgtttagaggatcctgtaactagattggttttccgtttattgttcgcgagtaccttgcgtggtgcaatagggggggatcaattttgaacaggcagcagcagctcattgtagatacatggtttatggagaaaacttatagtcggtagactaagtttgatgttcgggtaccacgggagtagctgattatcatctaaagatgttcgcattaggagttttaagtagcatagtactagataatgtttgagatatattggtactgttctgaggcaaaaataatggacggttctctttgttccgtctttttccaattcactgtgtatgatgtccttttgtcgcctgctgtaatgagagggaaagttggaatgttggccgtcaaatgtgcatgcctgattgccatgccgtatattgtccttggattgggacaaaagctggaagatgactctttatttctcgaagggttgagccgtatatatttaagagtatatgacgtgaggcgtgtgacaggtactagatctcaatttggattcttgttgctgttgttgcgtctggagctgcttatgtcccactgtttgatggtttcatgtacatatcgtacatggcttactggttttcagctggcagattactggtttccaggtggcagcatgatgatggtcaatttttttttgcggttgcctacgtgtccgtgctttcgaagaacgggtctagtttcttgtcagggcaatggatgcccatggttctactggagggaaaaaaaacaaaaaaggatttgaacccattttacgagtaacggttgtgcgaactattataccagaattttctttcaaaggaattattgttggcatcttgtcatccgttgcaaaaagctagtctcgaagttaatttggattcggacggacggatcgacctcttttttttttccggtaaaggacggatcgacctgtttgatacgtcgctaatcaaccaaaattgtcaggtcaagatcgggattttgtacaaaatcagctcaaactaagttagaaaggcaagaggatgtatcttccgtattaaagtttggtggtagtttatgtgcatgtttcaaataggagatgtccttccagtgataatttatggggttattcaaacaggctcttggtcactggatcgcccgatataaactgagaccatgagtctagaagagctccttgccgtccagagtccaaccctaggggtcttgatctcagttcttagctcagacctctcatgatccaaacaaacaaacaccaaaaaggaatcactcatgaagattatttcaatctcgaacgtaagctaatcatcacagatgatgcatgcattctacatcatccataaattttttgaacgtgagccaatcatcatgcatgcattctacaccatccagaatgcataaagaatttctgaacaccaaaagaaccatagcggtgtgctcaaacatttttcgctaaacgtaatctgttactcataacaaatgttaccctaaaaatggtgtgatgcccattttatgtacatttttttgttggtagaaattttatgtgcaatttaagagaggattggaatgcttctcacagctagactagattgagcatttggtacggaggctgagaatcatctctctcttcccttttttttcgttttcctttttttccttttgctaaggctgtctttaacacggttctagcatgaatcattatcttattgaaaggtgacgaaaactatgcaaatttggagcccacgggtattcctgttagcaacaaccgcatcaaaattataaatctgttaaccaaccggtcatcatgagacaaatctacaaggcaaatacatattccatttcgtccatcctctgaatcacttccataaattatttcatcgcttcacataataatttccacgaaaaacttccatggtagaatagatgcccagtgaccagaatggccagccaagcctaaattcatgatgaatccaacaatcaactttaaaacgaattagcaagtcagaataaaaatcccacgatcggtcaattaccaaactcttaggcatcactcagtaccagtaccttcgctgtcaactacgaaaagaattctaataaaacaactacagagatacaacaattgcagtcgctcagcatgcttgttctgataattaagcaaaaaaataattaaccatcaatggatacacaaaatgaactcatctaaaacacaatatcactcataagtagtatctaacatgagacgataaattttaaaaaaattctagctacaaattgcagcaaaagagaatccacatctgattcttgacaatgaacaatccaacattgatatgattttcatgtcaaaatcaaaattgcctgcaatacaaaggttgctccagttcatcttcaacaaaaccaaaaaaatgataaggcattcaaatggcatataaagcaaatcagaagagtgatgtccccttccccttcttgtctccgcctatctcaaaatgcttacatctctggcaaaaaggggagaaacatattaagaaaaggaaaaaacattttaacaaaaggaaaaaacacatattgcaaggccaaataacatcatattaagaacctttattgggtgctgggaatagtgcttgcaactctgacactgcagcttcagcacaattttcttcgttgtttttgcctggcatgaaacatgaataataataaatggtcaagaagctatcatgtcggctacattcattccaactatgatccatccatggaaatcaaaatgcttccgtaatgttaagaatcactactcactgctgtagctgggataccagaagatgagagtcattcactatataggataacaagatgcaaagaaaactggcgggtgcactaaatgccatggttaatatcctacaagtcaacatattctaggcaaaattttaagctcttaagatcagggagaagtaccttcttgtggaatacaggctttgtctgtccaccataacctgactgctttctgtcataacgacgcttcccttgagcagaaagactatctttacccttcttatactgtgttactttgtgaagggtgtgcttcctgcattctttgctcttgcagtaagtcttctttgtttttggaacattcacctgcaagacaaagtttttgataagggcctgccccttcaaataaggtaaaaagagagaaattccaaaaagcagctcgaagctacatggttggcggcatcttgaagagcaaagtactactagctagctggcaacgtcacccctaataatatacaatgcatcgccatgttgataacggaaggatgtctaaaaaatcatccaccctaaattgttttaggaagctctttcataccactttctcagttaaagcaagacaagcagttacccaagacctcctaataaagcttagggctgttcataattcggtttcagacagaaaaccggtccgaatcaaaccgaaaaaccgaatcgaaaccgaaccaaatatagttcggttcggttttcgattttcattttcaagaatttcagttttcggtttggttcgattaaaaactgagaaacccgaaaaccaaaccaaaaaccaaaatcaaccttggtcaactttatgaaatgattactaactcttatttaaatttatgttgtttactatgttaagaacttgttggttacatggatggatgattggatatttagatttgacctattgttataatttgctataatgcttgattgcttgtttgtattgtagatgatgtgatttttgatatgttacattttgcttattatcgatttatcatttatcaattaccaacgtaccattatttattaattgttgatttttaatgcaagaaattaccaattaatagattcaacagatcctgaatttaattaaatgtaatgtaacaaactaacaatgaatcggcaataattatttgaatatgttgtatcaaaaataaataattaaaaataaaaaaatagaaaaaaaaactgaataaccgaaccgaaccgaaccaaaattctcggttcgattcctctcttattcaggtcggtttttggttttcatttttctgttatttggctttcagatcgggtcgggtcagatcggttaaaactgaatgagcagtcctaataaagctggtcacaattaatgacaaaattgaaaaaaaaaaggacagcaattgaataatcaaaataaacctaaacaacccttgtcccatttatgtatgtagggtcacatcaccatctttaagctagactttgaaattgtatgaataattgaaatggacaacaaaaaagcgattaagtactgatctcagataatgttttaacctcatgaactacttaggacaatagtgcaccttctaaaattatacttgtagcaggtttccacctcagaagatatttatggcaatctttctgacaagaacatactaaaggagctaatctatgatatctaggataaccagcagtatttgtggagtcaaattctcttatgggtaatgatttgattacctgaagctcaaaattacaagctataaatggagaaaactatttacaataaacatagacaggatcaatttactagaatatgatgattcatatgaatatagatgtgcgtgctggaatatgataacaaaaatattacatgaagaaatcctagtggtttcaaatattctggcctattctaacaaaaaatatatattttaagaggcaaagcttgaaacttgaatgaaatgccatttatgatttcattctgcatagtaccaatctctgttccatcaagaagtgcatccaacaaaaccatatgccactataatttcaatcattttaaacgacaaccttataataactatcaaattaccttccagcttattaggttatagctaatccagggtttgaaactccaaaaccactagaacgctctagcactcgtacaccaagacaagcatagtgctacactgaaacaggaaatttcaacttatcagtctatccttacaatttcaagtgttttgacatagattaagcctaacattaagctctaagttcgtttaataaaaacatgtcctgtaaatgtcagaacgtccaagcaatttccatcaaactggttgcctcgagcatcatcataacatgtcaaattcaattacacattaagctctactacctagcacatccaatgtatagaatgtaatcataaaatgatggcaacttaaaaatcataggaaacactatgactcccctcaaaatgatatctcaataatttgacacagacatcgccgagctactcttagttcataaaaaataacctaaggttctatcttcatgggtcaaacggacgcctcaccgtcaggcaatatactcaaacttttgttttatgaccaaagtaaaagaagaggaaaaaaaaaaccaacattaaaacatagcaagtcctaacctaaatcataaaagcaatcattgggtaagcagcttccacaagattttctccgaaattcgcatgaatcatcagaacccgcctcaccatcaagatcaaccattggtttctcaaatctaaaacccaaggcactcaacccgtaaagatcgacattttccaggcctctaagcctgaaatcttgtaacagtcaaacatccattgtcttctaaccggggcaatgtcaaatttgaaaccatagaagaacactcgaacgataaaatgcccaagaaacttaaacaacgactccgccattaccaaattaaaaaaaaaaaactttctccctctcgaatcgcaaaaaatgcaaagtatctatctctttctaaatccatacttccacataaattttccgaaactatataaatcgatttccacttagatcaatggatgaaagcatgctggaaatagaaggacaaggagatccggcttggaattttctcaatccgatatagaaagaatatattagaagtggaaaattgatgattttaccatggttacagctacggttagggttccgactgctccaaagaatcctcccactgtgcaggccggcgggacgaagaagccgatctacgaagtgttcgagccttttatgttttgttttggggatggaacgctagggttagggtttagaaatgtataaatttaaattccacttttgcccttgtggcatggtaggccgtaacaaatgggccagctcttttgttgaacgaaactggacctaaacaactgttccgataaacatgtaatttgttttgatatttgtaactatacatttaaaaaaattatgctaatgatgattgattttggatttttcacgggcttccaagagcaacgatcaaggttgacaccatttcaatctttgaaaaaacggtagttcatggatggtgttattgtggccagggttgcgcactgagctaggttgacctaatggacttgagcatggtcccattcaatgctagcttaagtagttttatctagactgcacatttttagttgttgataattaggacatgttgggtataaaatacccacagccgaaaccttcgacggaatcagaacagctccgcccggactcctacgggagccgggctccgccgcgactacagagcagctccgcccggactcctacgggagccgggctccgccgcgactacagaacagctccgcccggactcctacgggagccgggctccgccgcgactacagagcagctccgcccggactcctacgggagccgggctccacctccgacatcgactgcagcacagccccgcccggactcctacgggagccgggctccacctccgacatcagcacagctccgcccggactcctacgggagccgggctccaccaccggcatcagcacagctccgcccggactcctacgggagccgggctccgccatcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctacgtggcaggctatgacaatagccacgagtctaccccactacccttcgcaataaatttttctgaccacgggcggcccatgaccagacggttacaggtgtcgccatcaatccgttgccccccccgcctataaaagggggggactcagatacgttattctttaagctcattttcttatcttaaaactctgctaaattctccgttcgagcactccattcttgttgaggcagagaactgacttgagtgtcggagggtcttgccggagcaaccccacctccggtttaaactttccttgcaggtcccgacggcgaccgcggcttccccgactccagcttctccggcgcaagcagatttttgcaccaacaggacaacatacagcctaaccctaagttgttccaatggttgctactcaatcagctaccatatttacttctctgagtgtatgaactatcttacgatttggaaagtgccccaacaaaaggaaacaatcttttagcaaagatgatacacattatggtcccttggatttttggttaaagaggcaaaccaaagccaaaaaattttcaatgattttgaacatccatgtatgcaccttagctatgcatgttgcctctctggtcacccatgccttcacatataaagatagcgtaattcttggtatactgcatgtagtgtagaaaaaatacatcgctccatctgattggaccatgtagccaccgcttttcaacacgcatttaatgtctgtagttctatttttttcatttaaaattttgaatgatgaaaatactcttctttttttgaaaaaaattataatattctgtgactatattatgacatcctgcagttaaattctgactttctgttcataaattgatcacagggtatcataaagaagagaagaacattttcatcatttaaatatttcataaatttttaatgacaaaaatgacttctttctttatgactttttaaaaaaagttatgacttcttatatggagaaagtcataatttgaatacaggatgtcataatattaccacagaatatcataattttttcagaataggagggacaattttatcattcaaaattttaaatgagaaaatagaatttcaagcattaaatatgctattaaatgcgcattgaaaagtaatgactatatactctaatgtgattgggtggtaaactctacgttatttttattgcaccacacgcggtgcacaaagactttctcataaagataagggagcagagatgatccgggccttgatcactaactaatagcccactaatttggtttcttgataccaggcctccgatcaaaagaaaaaaaagaataattagtatttattttgatatagggataggtatgtggatagtaatgaacctatttttgggtggtatcaggttattaggacagcgggcactaatcatcaagtaattttcggccaatgctccaatccttcgctctctctcctagcctaatttgatccacaacctattccgagcttagacagcccacatacacccaaaaaatatatgatgactattatcgggaaacaagtgtcagcaaaaacataaaaggtcttggattgaattttctaatgtttggtgttcatcttaacttttcaaccaacctttccatctatcctgctattaaggctgcacaaaccatgataataatgcgaggataaatagatttagcgacttgttacatctccatgacctgcccatacccaccgatcagaagcattggttctggaaacagggtctcaaaatttctatgaccacgtcagaaccataaaactgtacaattttgttaacgtctcacttactattgatcataaggtcatgaacgacagaagtatcatcaatagtgacatcaaaataacaaagaaattgagaaaaaggagtgtcaacaaccaagggctgtgcatgccattaccaacattaaagccttcaatgacagttcattaacgccaaggaacctatctaggaccaacttgggaacatcctgggcatagtggcatccaatatgagagaaggaagaaatagagaagtatgaaaggaagaaggtgtaaagatggcaatagattggatatggattggattagccaatatcaatatccatccaactattataaactctatatccatatccatctagtatctacctcgtgtcggaccgattcaaataaagtagatggtgtgggtcaagttaggtcaagcaaataagacaggttggatctagttggacaaggaattcaccattcaaacattttaaataattacaactttgtaagaagggatttagtttaagattacattagatcagatccagagtggacatgtcattatccaacattcgatccaaatctattttaggtattttccgtagaatccattcccgcctcgtgttttacttggattggttaaaacctgtcctattcggactggattaggatgggtatccagtgcattgactctaagggggcatttggttcgtaaccaaaatcagaatggaaatggaaatcggaatggcttagaatcagaatggtcaaatcccctgaagcatttggttcgtgaccgaaatcgaaatcaaaatcagaattggaatgaaaaattgaattcatagaggagaatagggattgagttctatatagattgacacattcccattccatcccgaaatcagaatcagaatgagactcttttcaactaaacggttggaatgggagtcaccaatttcgattccagaccctcactcccctctaccaaatacctcctaattgtcaagagggagaccatgtgagggtcgcaagatctgattatctcaggatgagaaacaaagatctctcgagttcggatttttttttccattgtgaaggatctgttcaatttgcaatcaatgctgtgcccatgcccgtcctgagacatgatcctgggttcgctcttcaagccagatgggcccccctctattcacagctctagttgatttcggtattgaaggccccaatagtggtcgcttggtcagcttggttgggaacgatacgcggtgacgccatccctcttcatacagttcaataagcgtatgtgctaaattatcaaaaattaaaaaacaaaaaggccattatgtattgccctagtttaaaaggatgtttggttcgtaactagaatcaaaatcaaaatcagaatgaattaaaataaaaattgaaatgatcaaattttctgaagtatttgatctacgaccgaaatcgaaatgaaaatttgaatctataaaaaagagtggagattgagttttagataaattaaactatttttattccacttcaaaattagaataaaactcttctcaaccaaatgattgaaatgagaatcattcattccgattctcatttcaaaccttcgttctccccttaccaagcatctcctctgctttttttttttttttttttttgtggtttctagaaagaatgacactaaaagcaactgatggcagaaagtttccggaaatcaatatcagtaccaatgcaatatctcactaacttgtaaagaatctcactaaaagtaggccctagagtagtgcattcgtctcatgtgatatctcatgtaaactcagactagtgtgaagcatagtcctttaacattttattttgtggtccaaagtggaatattgaccaaattgaatccagtcaatttcaaaagcacaggggaaaaatatggatttgaacttaaagttttacgaacccttgcaactgactcgagggaagttccatgtccacctagaacctcctccccaacttagttcggagcaacttggctccgcagaatctagaaaataaaatttagtgaacctctgtatttcctacttcctgaaggttagcaagaaacaaattttatctccaaatggatcatattcctatacaccaatgctcactaattgaacctgtccttactcaagagaaataataataaaacgacaacaacacaatttgatacattatccgtttcatgaaaaccttttcatttcttcaatcctggcccctcatagccggcaactaaattctttcatccagggatggatcaggctgataccataccaatgatagctaattgaacctgtccttactccatagtccgaaaaagcataatgataacaatataacttgaatatacttaggtaccgctaaataataatatgacatgcttagatgcactttttctttgggccataccttatttgatcattgacaactactcaaataaagtgagaatctcataaaatttttggtgaacaacaaggcatatggtagacctgaacaatcttcaaacatgttttttcctctcttattttcctgttcaatgcaagctctgagattgaatgattagagttgaaggtattttgcagctgtctggacatccttgtcccctcttccgctgcaattgacaaccaccttagctccatcaggaagggtcgggcagagcgtttccaggtacgccaaagcatgcgaagtctctagggctggaatgataccctccaattgtgacaaacgcttgaaagctgagtacatataaacctcatttaatagaatcctgagaatgttgataactgaaatcaagtataaaatatcccatgcatgtgaacaacaataaagttgcaagcacaacatggtagcaagataacaaacatatagctgacaacctagatacaacagaatgcaggtataaaggaacctagaatgactaataaataataatagacttcaaccttgagctgactggttaaggacaaaaagaattactaaagttccattaggtagaacagggtctaaatgctttaaaaattccatcattttgaccaagcattatcttttggtcaaataaatcaagcatgttaaggttgcagctggaagcatattgcttgcaagaaagagacagttcaattaagtgcacaactaatgaacaagcgaaacctcaatcctggggatacagcccaaacagaaaattcaccaagaagcagggtagaaaaaagtaactgaaatttcatcttttttcccctgaaaatctcttggatgaacatatccctatatatagaggccatgattagctgaattctcgtcctaaactcatcttgattgacttcaacattgttatccatctttacgtaaatattaaagagggagcatatagataaaggggagataaagtgatgtggtctcttcctgcttcctcctctaggaaaagtgggcatatcttataggattcagccaccattattatggactttattatcttgaacaatctcagaaaactaatatataagtgaaaattaagaattaaaaaatttatctgctgatgttgtttccacctttaaaaagaacatatataacttatacttcctttttgctcaatttttatggcattacagccaatctaaatgaacattgctccaaacagatcatgaagtagatctatatagaaggaatttctgcagaactgcattgtgtttcagatctgaagtttctttttcttctcttcactttttttctgttggtgcaaactcaaacatttagattcacaaactaccatatatgatctccttagttcacacctacactaagaaatattccccttgcaccatgtcttttgcagtattctacaacatatttgatgaaacagttcacaatcgaaaaggcatttcatacttcaagagacaaatgacttttctatatgcattttacagcattatactaaagatacagatagagattaataaaccaaggggcccaaaagttacttcacttcttataaaaactgcatatggttttgcataaacaaaattagtatcaacaatcatatcaactatgagaactattgcttctataccttccaaggcctcttgatcagtgacactatagtattcagcacgtcctatatctttcagaaagctgtgctctggtccaacaccagggtagtccaagctaacaaatttaacagagaactatcagaattgaccttgtaagtatggatcagaacaaaataaattgaaacatcataatgtggataaaaagtttcaggaatatgttactagcatactacccagcactaatagaatgtggctcaattatttgtccatcatcatcttgcaataaatagctcattgctccatgcaatacgccaacttctccttttgttaaggttgcagcatgcttaccactgtccaagccatgtcctgcagcctccacaccaatcaatcttacatctgagtcatcaacaaactcatggaagagtcccattgcatttgaacccccaccaacacaagcaactagaacatctggctttccaccccatttttccattgcctgtcttcttgtctccttaccaatcactgcatggaaatccctcaccatcattggatatggatgtggaccagcaacagaccccaaaatataatgggttgactcaacattcgtcacccaatcccgtatagcctcagaagtagcatccttcagcgttgcagtcccagaatgaactcctctgacctatggaaagtcaccactacaacagttcaaaaatcgatcaatgatactatttacattagttataagaaaaaaaaagtgcaccaaagtgacagcttcataaagagtcatgcaagacctccagacctagcacattaccacattatcaacaagatgtgtagaaaatgaaacaatattaaaactctatcaactgaagatcagcaaaatagagatcaatgtttttcactagctaatgaatcagattctaaaacatactatgaaaaaatcgtcaatgcttttttcaatttgtcatcatatctcagaaatctaaaaaaaattcattaaaaagagaatgcattaacttgatctagctatttaagaaatccaaaatacaaccacttttttcattatactccattaacaaatgaaccaatattagaacaacagaataataaaatgaatggtttgcagagaaatgatgatcttactaaaaaaggtcgagcatatgaatacaatcacgctacttctaccaggaagaacaatcacgctgcttctacaaggaagcatcaaatctactgattttctagcacgtctacaacgcaagaagatgagattccttaagaattattgaaatatacaagacaacataaaacctcaaccaggtttgttctgtatcaaatgaattttaattaacacctgcaatatcagacatgctaacatagttaatattaattacaaacctctgctccaagaagcctcattctgaaaacatttagggcctgcctctccatatcctgagcacccatgtaaataatacactgcaatccaaatctcgcacatactgtagcagttgcaactccatgctgcccagctcctgtttcagctataatgcgctcctttcctaaacgctttgcaagtaaagcttgtgcaatagcattgtttattttgtgggccccggtgtggttgagatcttccctttttagatatatctgcggaccctcaccatttgaccgtttataacgttctgttagtcgttctgcaaagtaaagtgggttctcccgaccaacatagtctttaaggatcccgtccaattctttctgcaatagaagaaaatagatgcaaagacttaacaagctgatgaaaagactagaaattgtagtatatcagatagttgctttaagttgtagaaatacaaaacagacaagtaatcaaaacatatttgaatgtcatcacacaaatttttgaaaaatgaacaagctgatcaacatgggctaaatttcttctttcggatgcaacaatcgcatctcataggccagaattattatttctggtaaattttatgttatacataaggttactctgatgttaaatactagaattaggaacctagacatattcgttgaaatcaatcgttcatccatttagcataggagcttgccaagtcactacccaaaaataggtttggaccacaattaaaagttagaaaaactcagaatatggacccaataaccttaacaatttatcaaattaaaaccactcccaccaactgctcccagcattcctaacttacaccagttgatgggtaagggagcatgcagagtgaacttgctgcagaaagagtacacttttatgtgatattctccatagaaaacctcaaagttaatttacaaatcatactgctattatgctcatcctgaccgaattcttttgaacaaaaagtttttctaatgtatttcgcaaaatgtaaacaacaatagtcattttttataatttattcaaattatacatgatctgtgcccttctatttagaaaaggcttggattagggttttcctttcccgaaacatgcaaaagtacaaacatatcaatcgatccaagcatacttgcacgcataatgtatacgcataatatatagatgttcacataaccaacaatgcatatattttaattagaccttactcgcaagagaatatatcaactgatcgagtagatcgacgtcttcacaaaaatcaccaaaaaagtctggccaactaaaagggagataacttttctatgaaaaatagtagatatatccgatccatgtttcttttagcttatattcataaatataattctgataaaagacacataaattcaagtccaaataaaaaaagaaaagaaaacttaaaatttgctcaggacaaagggaacaaaatggatcttagcagaaattgaaaaaacaataatacatactagctgacaaggataattaaagagattaaaaaacttcaaatccatcattatcaatttaaagtgacaaaaaccaaggggaaaggaatcgaacctggaaatccccatcctgggagagagaccggaaggcggcctcgagctcggcgagggcgtgcattagggtttccggcacgtacttccccccgaacctcccgaatctgccgaacgtatccggccgcggggccgcgccggcccggctctcctctgtcttgacggcggccggctcgcgggtgagcgtacaagagacggcacggcagggtggtgaccgcatcacggaggggctcagccgggatttctccaatctcagcggcatccggactccatggaaggacgagcggggcacggtaggatttccgcggacggaattcgcggcagtggccatcgcgcggcgacggagttcgggtttggctgcttcggtgcctccctcgatgacggggggaccctttaacgtggagggatgggtcctgtaggcggtgagtgttaaaatgtggacatggcagagcggcgaaaatcccgttgatgtcgcgaccaataaaggccatgatgacgtggcagtcgtctaaaccttttgaggatacacgaacctaactacttgcactaatcttcgcactcgttcccaacgcggggggaggaaaaattattgcctaaaccagcgcacatcgcggagcacgtgcacggtggataacgcacaagggttaatgtggcgtgttaggatttgactggtctgcctggaccacgcccagccaataatttctccgaggtaggtgagatgggcatttgtgggtgcacgccggaggattacgacgtggcacgtttggaaagcataatttttcccacgccaccatgtcgaagcgcggggcacaattcgttaggactacgtaacaatcaaggcttccctaattttaaatcaccgcagcatttgtctcatgtttatctttcaaacctaaagaggatatttggcgcgggctgatacatccagatgtacaaatgatgaaattaccatatttagttaaatccaactttcttgtatggcaggaaataagatttcagatcaccctattttttcaattactattcaatttagtgatgaaaaaatctatttttgaagacagatatccaagttttgggataaaattttgaaacactcttgcccctccatccatctggatgaatgccaaatcctatatgttggatatgagattttaggaaagtgtcattcaagaaagagtattcacgaggaaacaccgtccacgagtgatttggattcctatcttatttgattcatattcatcaaccaactcataaatagtattgttggatagatatgtggccaggataccaccttccaagttcttttcggtattgcacgatgcagcaagaaaaaagaagaaacaaaacaaaaacaatcaaaatacgtagatcagccacaaaaggactcgtcttcacggggcatacaaacttcactacgaaaaaaaaatttacaagaggagatctcaccctcaatcctcgtacaccaaatttctccctcatagaaagttctccctcacaaaagctctctctcttggaagaccccccgaactcctgaaacgaccgctgtccgctattcagaagtcctgctccttctatctacagtgtacggtggctctctctcttcttcgggttcctgatcttcagttttcacgagaccgtagccctcatgggtttctatgagaaaaaccaagccatcacgggtcttctgttgagaagccaaaaccaccgcaataccttctctgttgaacatcaagcctatttataggctaaaaacccaattagattacgattaggagtcctaaaccaatccaaataactcccaagccgttggatcaagaccacaagccacccatgcccaccgatcgtgcgacggtctatagaatagtaccgtggaccatgtgaaacgcatgaaaaatgcccatgcggtctacagacccgaccgtagactgctcggtccacggtggacctgggtataggccccagcagcgcctggacctgagccacacctgcgtcgggcgcctgggcccgggccgcgccccgagcgtgcacctaggctgggccgcgcgctcgcacctgggtcgcacgccacgcgcctgggtcgggccgtgcgcctgcatgcctggcccatgctctgccgtgcgctgggcggcgtcccttctcttgcaaccacaccgccgccgctccgccggcccgccgtcggcagtcctccgttacctcgaattacgtgccgacttcaaaagcacgtatcttctccgttcgagctccatttatggtgatcttgatcttgttggactccatttttcaccgcaaacctcactgtgagctcaatgtagatagaatctcgaggtatcaaatcctatcaatctccacttcgacttgttattcagcctcctcctaacttcgagagcttctggatctcttcgtctccataccctggagcaatcgtctgctgatcatggaaaggcaaacataggagtcaagtcagaccgctcgatctcatcttcgtcgtatgctgtgttcctcttgagtctcctgtctcgtgcccgatccacctccacctggagctctacctcgctctgtgctccacttggctctcgaagctccacctcgcactggactccctaccaggtaataatgtcctctactccccttcttctcctccagcacaatcctatcgccgcgtagcaccctcagaatttctccaccagctaccatcctgtagcctctcgaatccaatctgctaagtgagataagactccgtctgaaattggatatgtatcgaacctcccccaatctcctcactgcactatcatgtgtcctccagctgaccgttccgatacctctaatcgcatagctcgatccatccggtagatatacagtgccctcactgttctctaaacagtcaaactgctcctctctgcaacatacatgatgggtgcatgcagaatctaatatccactattggaaagaagtagatacctcgtcagatttcttcaagacatctccatctgaattgctgccggtcgtcgctacagcagccaccgtccgatttttaagttgaggacaatctctggctagataccccaactcctcacaccgataacatctggctttgctcaagtctctcctagatttggaccgttctcatcgcgatcttttgtcgctccgtctaccgccttctgttcctccagaagctaccaaagctgagctaccgccatctgagctcgaagctgggttctccctcttgagaacctcattctggagtatcgccgtggtgacctcgtccatcttgatagcgttcttccccactagaagagtagtcaccaaaaactcgtatgaaggtggaagtgacgctagcaaaactagcatcctgatcttctcctcaacattctcaccaacgctgtggaggtcgatgaggatcttctgaaagtagtttaaatgctcctgcacgctctgtccctcagccatccacagctggtaaaactgcctcgagaggaaaagagtgttggtgaaagattttgtcatgtatagctcctcgagcttcgaccatagcaccgtcggagaagtctcgctcagcacatggatcaccatctcatctgctaggtatatgcagatggtactcactgtctgtatctgtagccgtctccaatcttgcacctccatggtggttggcttctcctcgcacaagagagcatcgatcaatctctgttggatgagcacgtccttcacccttgcctgccacaaggagaaattgctcttatcatcaaatttgttgatctccatcttgattgattatgtcttctccatcttcagtcttgctcaccatcgctgcaatctacgttcttgtaccgtctcgctctgataccacttgttggatggatgtttgaccaggacaccatcttccaagaccttttcggtactacatgatgtannnnnnnnnnnnnnnnnnnnatcagccataaaagggcttgcctccacgagacatgcaaacttcactatgaaaaaattttttacaagaggagatttcaccctcaaccttcgtacacccaatttttccttcacaagaagttctccctcacaaaagctctctctcttggaagacctctttgaatccctgaagtgaccgctgtccgctgtctagaagttctgctccttctctctacggtgtacgatagctctctctcttctttgggttctgatcttcagttttcgcatgaccacaggcctcacgggttttcgtgagaaaaatcaagccgccgcgggttttctgtcgagaagccaaaaccaccacagtactttctctgttgagcatcaggtctatttgtaggctaaaaatccaattagattacgattaggagtcctaaaccaatccaaatacctcccaagctgttggatcaagatcgtaagccacccatatcctccgatcgcatgccggtccatggaatagtattgtggatcgtgcaaaacgtgtgggaaacacccacgtggttcatagacccgatcgtggaccgtccggtccatggtggatcgaggtacaggccccagcggtgcctgggcctgggccggcccatgcgcgcgggcttgggccgcgcccgcatcgggcgcctgggctcgggtcgtgccccacgcacgtgcctgggtcgggccgcacgccacgtgcctgggccgagccatgcgcccgcatgcctggcccgcacactgggcggcatcccgcctcctgcggccacactgccgccgctctgccgacccaccgccggccaccgacgatcctccgttgcttcggattgcgtgccgactttaaaatcacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatatatatatatatatatatatatatatatatatatatatatatatatatatatatatatatatatatatatattattttttttttttcctgaaggttagttttatgttctttcaatttaaaatcttgatgtagtccaacaattaaattttttatagcaatgacccgaaaaaattgctgtgagagcatgtagcacaggtgaagtttgaaatgcgcgcaccatcatcgtgctgaacatgcagaatactttgctaatatgaaattcaatagcaatagatgatttttagaaggtttatgctaaaaagtaatacccaaacaatgacaaaataagttatacttaactgggcccccagttcgaggagaaattattgcatggacgaggtcccagtcgaccagggcaattctcggagcacataacatacaatcgggaattggtgaaatacaaggggtaatgtggcgtgttatccaccgtgggatttccattggaccttatccaagcaataattagggatgtttcattataattattataattgtatgggtcttcaaggttgcaagatgggtcttcatttttgcaggttgggtagtggctggatcatctacaacttacattatcattgctgctttggataacttcacaagttcaaatgtgccaattgctctattctcatgctttcaatatctacttggtttctacgagcatggtatcacggtctttttttggtaaaggagtatggtatcacggttctctgaatctcttttctctactaatagaattttagtgtacagctgctcccatatgatttactctaaaaagaaacctttataaccttttcattgggtttttatgcgctgactgattattatgcttccttcattcctacaattgcgatctacacttcaatagagacaaattaatcacagatgttatgcctcatcaacttactttgctttgcttaatcagggaaagcctattttacttaatcagagctgctgttcttcatcggattatgtgtgcctatcaacttccttctatgcttcttacttcactttgcatattctgtacgctattttcagttttcctctttcaaggggatcatcattgcttatactgtcttctcatttctttctgctaccaggtgttcaagttgtgtaccatatttcattgcaacaattctgcaactgacgtgcgaagagtgtctattatgggtgtttcatcataatagtaagggtctccaattttgcaacatgggtcttcaattttgcaagatgggaaaacttaatcacagccgctgttcctcatcacattactaatcaagggggtggaggggcaacagatggctatacaacaaaattgttatgctaaaaatcccccaggagaagtacgactagaaataaattgataaattcaggtctagaccaaaaataaaataaaataaagaagcaagaaataaaacactacatcaaactcaaaaaagaagatctcagacactgacctaagcttcaatcaaaatattaaaaaaaaataaaagattccaaaatgacaaaaccaaaaaagaaaaaaataaactgataataaaaaatattatatcaggggctcattagaatcttctacatgtagagtatcaccacacctctaccacccttctggtaagaactactttcattcctacaatataaataaaaatgaaagaagctgacatctagaacaacgatataaaataggggctaccactgcaaaattcttttctttgcagtccccttgttccaggcttcgagctacaagcagaaagcagaaaaaaaaaaacaatgaaattgtatatacataaatacgtgcatgtacaattcacattttattagactaaaagatatgaatcatcttaatagatgtatacccattttgaaacacattcatcatcatctagcatgttagtctcaagatattagcagaaacagaaagaaaggatgtcatgcttcaataccatgctttgcaaaaattggcataccaattagttattggagggtcaaagagcaacagaatactgtctgccgcatggctgtcttagtgcatgaggattctaccactacaggatatgaggacgttcagatgtacacaactttacacctgtgcatgaagaagctacttccatgcttcaaacctatgacaccaaggtcataatgaagcaatagcatctatcatatgtacatacataaatgcacatgtgtatatgatttacttattgtccattcatctagcaagcaatggaggacataccaaaaacatgttagcataggctacttagagtacgcatggccagcaatctgcatgtctgatccaaaacatgaagcagttaaagataactttccctgcttgcttacaaggttataaaatatttatcaataaattggtttttccttttcttaagccacatgataccgacaaaacacaaacaaatttttttttcaaagaaaaaggaaaaggaaagaccaataactgcagcaagaggtccatgcaccactttcatgggccaaaatagcctcattttagattccaacagttcctgagcattcattataagtgccgaggaaaggataggagacaaatacggttaaatgtgaaaatggacaaacttcatttacctaggatggcccttgttcaatgagaaaatatgcataacatcatagcatcacaagtttttcagaattcagatgaatgctgaatgttttcaaaatgaagggaggaaagagaagtaatggaattttctaaaagcaatcattgtagagaaaaggtgaaagttttgcatgttacagatcaaagaagataatccaggagatctatgcaatttctagattgaatcaccactacaaaaggaccaaaaaaaaaaaaaaaattccaagctgcttcttcagtggcagattccacatgacaaaaatcccttaaagcatccatcatcagcaacagccacctggacttcaacaatctccccttcccctttaaaagattcagccatgcaagggaaagaagaacattaaaagctgtgctcatacacacaaaaggcatgtagataccacaacaaatattatttgtgtttcagatgtctgattttgactactagcaggagttttaagctgcactagactgaattaccattagttttatacacttataaaaccagaatgccactaaaacttctaggttgagtaaattacccccttcttttctgacttttacagtttgttttgcagttgcagttgctaatggtgcaactttcatattcatggctggatttttcatgttttagcatttaaaaaagcagagtaaataaattaaaggtaatatttaaaaaatgaaatgcaagattttgaaggaaaaaaaagggaatatgtgaacacaactataacaccatatgtgaattattggaactgacttgctgtagcttctttaatcttcgtggcgatcctgcatgttttaacattaaaaaataacaaacaagttaaagacagaatattctaaaataatgaaatgaaagatttcgaaaaaaaaaaagaatatgtggacacaaatataaattccagacccttaattactggaaaatgacttgctggtgatatctatagctgttcatcaaactctaaatccgggtctattaattgcagaaataaagaaaatgtttcgttaaaatcgtcacaagtatatgcaaggaaaaagaagattgaatccattatctcccaactaaatatcatatgttgatgacaacagaaaacatgcccaaaaacaatgatcaaaatttgcgatgccaaatcaatggaagcaacacactgcatgcacaactattatattactgcattgagaccatccaaacacttcacaccatccagtcagaacgagaatgaaaactgcctgtaaggttgggacagatggaatgtcttgtggagcacatctggtgagtgtagattcaagggtcgatgtgaactctttgtacaactgggcctctttagattgctaacaaaatgcagaatgtgatatcattacttgctcaaagagtgatgagctcacaagaatcatatggaaagaacattaataagttctaagttaataaacaaaatattttggttgcttcagaggaaacctgattgacagccaaatctaaggcatgctgattaaaaattagatcccttcgtcgagagaggggaatacttgtagaagtaggatcacgtttgttgctggtggttggatactggacgtaagaaggctatgttcaaactaagtccaaatcaacatgtcaaagaaatgccaaagcagagaaaatacaaaaacaaggaactacaatggtcaaaaggaacaaaggagacccaagaataatttaagattcacagcatttaagagacaagatgggtaacactccaacttacataacaaagaccttagatttgaaattaagtctacatcagataattctaagaaacaaagaaaaataatacaaaaaaaaaaaaaatagtttaaaggaaaccacacaaaacctagatcatatttaacacttgatccagccctgtaaccacaaatataacatatagaggcgaaaaagaaataaattattcaactttcttgctcatagagaagagaagaaacaaaccaatatcgagaaaacagaaaagaaagaaccaacgaaaccaattaaacagtaacagctacttgcttgatctgggtaagtccatgccattgagagcctcaacacctggctgaacattgaactcaaataaatggaatccaaattcagagcattcaagaggcaagatatataacgctaagtcgaacttatataacaaaggccttatatataatagaaaatcaggctgcaagaaatattgtgaaaaaaaatagagaatgccaaactggaaatagtagatccaagcaaagcatgcgaagccctttaatcatattataacagtaaatcaggccctgcagatacccgacagatataatgtaaagacaaagaaaaccaacaaagccttccgctttcttgccagcacagaaagtaacgaacaacctaatttcaagaaaaaaaacaaagaaagaatgaaacaaataaaagaaccaaataaacaaaagaaagaatataaacaccaccttattgctcgaagtgggtaagaccatgccattgaaagctccaatggcggatcaaaacattgacaccaagccctcaaatattttagggttttggttggttcattgcccaaaaaaagcagtacaatattaaaaacaagaagaaatttgggcaaaataaattgctgaagatgagaacagagaacagcatcgaatcaaataagtcaccaaaagtggtggaaaaagagagggggaagagatgctcacctcgaagaaaagattgtgaattcaagcctttcttgaaagagggtattaatgggattacctaatgtgaacaggatttcctgtcagaggggcgcgatttatcaacttgagaaccttctcggctttagagagcagcagcaaggttctaaagaagggatcagaaatcgatcatgaacacaaagagaagtaaaactggaggttaggaaaaaaggggccgaaggttggataccaagatcaatcaaaaggaacttgtgatcaaggcaatggaggaaggtgccagagttcaaaagtaaaaatctgggtgatcataaggaaacctctctgcaagatccaaaatgttctcttcaagaaagtttgaatctgcagtaagttcaaaagtaagatacaaaatcctcttcaagggatttatcaaaacctccgaaaatatggtatggctcaggtcattcccactcttttggtaagaaatattatccctaatgcaatatacaaaatatgaaaaaatttggcttctgtgtcgatataaaaggggcccaatactgtgaaatcctttactttgaagtcttttcttttccaggccacaggctatgagcagaatgaaaagaaaaacatgttctttctcatgctttaaaaaaatcagaggcccaaaaaattattaaatagacacatttatatcatttactctcgtccagaaacaactaataggattattaatcacctcagtggtcatcaatttgttgaggcatatttgccatcaccaagcatgcaaggggaaaagccaagaacttggctgaataggctaattagattaaggccaaatcaacatatcagaggaatgccaaagcagagaaaatacagtggccaaaggaacaacgaagacccaaggataatataagattcacaacatttaagagacaagatgggcaacactaaatccagctcatataacaaagacatcagatttgaaattgagtctacatcagatattctgcaaaagcagaacaacaatatgccaatactgaacaggagaaaaataaattaaaggaaaccacacaaaacctagatcatgtttaagacttgatccaaccctccaaccacaaatataacatgtagcaggagaaaagcaataaattgtccaactttcttgctcatatagaagagaagaaacaaaccaacgtcaagaaaacagaaaagaagtaccaaagaaaccagagaaatgctacagctacttgcttgagctgggaaagacgacacctttgggagcttcagcaactggctgaatattgaacacaaataaaaggaaactcaaattcagagcattgaagaagcagatagataacactaagtcaagcttatataacatagaacttataaattaaaatttaaagctacatgaaatatttagaaaaaaatagagaatactacactggaataagtaaatcaaagcaaagcatgtgaagccttttaatcgtatataatagtaaattcagtcctgcacaaaacccagagatctaatatccggataaagaaaaccagcaaagctttctgctttcttgcttgcagagaaaatgctgaacaacaatatcaagaaaaaccaaagaaggaacaaaacaaacaaaagaacaaataaaccaaagaaagaagataagcactagcttattgatggaactgggtaagaccatgcctttgaaagcttcagaggccagtcaaaatattgacaccatgccttccaatattttaggattttggttggttggtagtacaatattaagaacaagaacaaagttggacaaaataaattgctaaaggtgaggacaaagaacaaatcctggatgaaataagtcaccaaaagtcaggcaaaaagaaaggtgacaaagatgcataccttgaatagaagtttgtgagtgcaagcctttcttgaaagaaaatattagtgggatcacataatgtgaaacgattttcctgtcagaggtaataaaacactgggtggagtgccctttataaaagtattgctttcctccttgccttctgggacttcaattcttttttcatttttacatgtcaccccccatggttgcttctccagcatcttcccccacttcgccgacctctgcttcttcgcttccatgatggcaatttacccttatccctaatccacgcctttttacctctacttgtgtttctcgatcgatttcttgtcccttctttgtgctctatagatggtgaagtcatttggatcatgcggtctaaccaaattcttttaaaaaatgctggcttctgtaagatttctttgtgcagttgagcctctctatctctctctcattttttttcaccccttctagtagtttatttcgtcaatattcctcatgtttagtaatttattctgttaaaatttgttcttgttcttgatattgtgctacgatctcagtgaagcatccccatattattccaagtccaggtcttaatgtttttatccaccattaaatttctcgacgcaatggtttaaaggttccagaaaaaaagctaacagtgcatatctgtttcttcttcttgggctttttttttgttctttcattggtttggttctttaatttcttttttgttgacatcaggttatttctttgttctttcttctagcaagaaagtagatggcttttgttggatttctgtctccatatacaatataattagattttctgtatgtccaaattgattgttgtatatgatcagtgccttttgtggtatcctatgaattacttatttcttgtttggtgttatctttctttaacttttaaagatatttgatgtagacttaatttcaatatctgttgtcttcattacatgagttggacaaatgttctctatcttacctcttgaacgctgtgaatgctaagcgagcttgggtcctctctgtttctttgatcagtattattaaaaaaaaaagtattgttgggggatacccaccgaccgaccgaccgactatcggagggcccgaccgactggcggcccgaccgactaagcccgaccgactaaccaacggcccgacggacgactctgactggccgatcgtcggtcgggcgacaggccgacggacgccatcagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgaacccatcagcccatctactacaccagcaaagtgctccacggcgccgaagccagatactcggagacggaaaagatggttttcgccctgaccgtctccgcgcaacggctccgaccatacttccaggcccacgccatcgtggtactcaccaaccagcccctgagggccgtactgcgccgacccgacacatccggacgactcgctaagtgggcgatgaagcttagcgagtttgacattcagtaccgaccgaggcctgccttgaaggctcaggtcttggccgacttcatcgctgaatgcccgacgaccgaccgaaggtcgggagctgaaggcccgggacgagattcggtctctgagccagacccgatctccacctgggtactccacatcgacggagcctccaacgctcagggaagcggggccgggctcctgctcacgaattcggatggggtagtcaccgaatacgccctccgattcgacttcaaggcctccaacaatcaagccgaatacgaggcactcctcgcgggcttgaggatggcgaaggaactgggcgtcgacagcctccgggcattctccgactctcagctgatcgtggggcaggtcaagggcgacttcgaggcgcgagatccgatcatgatcaagtatcttcagaaggtaaaggatctcgtggcccgcctcgagcatttcgagatctcccacatccccaaaacggagaacgcccgtgccgatgctctctccagattggcaacgtcggcctatgattctttgggtcggatgtttgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccggagccgcctcgggtcagtgcggacttccttttgcaggtgcacgcttcccggcgatcgggcgacgaggcgattggccgcaacaagtattttctccgttttgatattctttcaatacattcacgcatgcttaatttgagtatcacattctacatcaagtacagaactgcaagtagaaagtattattccatatttatggtgttcctctttctctggactaaaggttctgtttgtaagctagaaatgctttatcatcattgggaaaaatatttgtgaaatcttgacctgttttagaatttgacaatcaattaggtttaaaccggaattatgaaaataaactggaagcaggaaataggaaatacatgggataccacacagagcatcgatcatatacaacgttcagacatgcagaaaatccaattgtgcagcatatagcgacaggaaaccatcaaaagccatctactttcttgctagaacagacaacgaggaacagccgaatgtcagcaaaacaaaattaaagaacgaaaacaacaaacgaacaaacaaaccgaagaagaaacagagaaaaccgtgtaaactattgtatcgaaaaatctaatggcggatgcaaacattgacacaggacactgaataatatacatatgaagaacatgaacaaactgaaaaaataaatcaccaaagatgacagaccttgatgaaataaattcctgtaagaaaattgggaaagaaaacggaagagagaggctcgcattgacgaagaaatcacacagcatttctgattagactgcatgatgcgaatgaattcaccgcccatagggacgagaaaacccaaatagacggaaaaaagagagagaatcagggatccaagaaagatatattccatggcgaaagaactacttgaggtcggagaggcggagcaaggtgccggagaagtgatcgtgggggcgacagtacggccgaacgagcgatggtggtggcatccagatatcccaaactcaaatccgcccatggcggcatggcggaccaagcaacgaccgggttatggaggtaataaaatactagattataaccccgttgcgattgtttttaaaaaaatattttattttattaatatattatcaattattctacatgtatttcaaaaataattaaaaaataaaaaaatattttatatataatatagattataaattatttataagttattttatttttttcttaatttggattcctcagtcttgtttcttttcaaactttttttttgagacgatagatcttatttctaatttaaaaaatttttacattaagaaaaaataattgatgggggatagaggcggatgcttccgttatatatatatatatagagagagagagagagagagagaggagggtagggtggcgccnnnnnnnnnnnnnnnnnnnnnnnnnnncttatatatatatatagagagagagagagagagagagagagagaggggttgggtaggcgcccgcatagagtcggtattggtgcgtgagtagaattaacgcgtacgaatggtagacgccttggtaaattagacgcatgcgtataatatacaagtacgacctcaggatctgccattcgcgttaacaacggcgatccatcgtatccgttaatttatgggtgtcattatggacggttctgatgctcgtactagacgctgtagtctaacggccgatctggaccctgatccaaatactttgccgtcgcggcgatggaacggattagatttaattaaatttgacgcgattgtatctggtctggcggtggctgtctgaggtcggacgagacaagccgaaaggctgatgttcttccaagtgatctgatcatcacccatttcaaaatgaaccgcgcaaacgatttggtctatttgatcgagattggtcgagactggactacttttgagcacattaaacccatgtcaagtcttggaatcatggtctatttgatccatgttagatttcagcatatttggtggattagagctttgttaactgtttgtgatacgatactgatttttgtatctgtttcggttcattatacaatcactcacacacaataatgacaaaagcagtaacggataatttagacatgatgcattggagtataataatgatgggtgtaccaccaattatttttaagaaatgatatgaaaattacccagatcaaagataagcaccttccaaggtttgatggaatttttcgctatgtacaggcttgcacttacaagacaatgattatgtaaccacagaaagcaaaagagtaagaaaaaggaagagaggatcctagaaatcgatgatgggttctccaagtgtcagatttctctctacggtccatggcaggttaaagagcttggctgttatgaacttgaaaattttgttcacatttatgttgtgagtagcacttgaaaaaaagagagtagcgttcatcactcttgcacatgctctggcctgcccaaataacacgagacaaatccagcttagtttcttttaaaaaccatagtcaagccataataaagtgacaaaataatatttttttctttgaaaaagatataaaaattaacaataagcctgcgttcagtgaactgaggctagctctattggcccggtttgccattggctcccacctacggccaaataatattcctttattatttttatcccaatcgaatacgactacaatatcaaaggtagaatgcagtgaaaaggtgaacaattattgaagaactaagcaaatcaattttccatttgagattaagaatagagagtgtgacatgcattgattaatccattcgacgacaaatagatcatttcattgacggagcgtggctgtggacctatcactcgaccacttggggataaagtggaacgaagatgcgtggaaatgaatcaaattcgaactctttcggcccgagcgtgtggaaaatcccaacgcatgcaaatggggtcacaattattccaagaaatgggccccatttctggaagctctttggtccacgtttgacgaggccgaggacaagggctccatcaagctgaggaccattatctgtattcggtggtccaaggcgctccatattccatacttcgtttttctcatatttgtccatggaccagttagcaattatctctgtttcaggtgtataattcctaaaaaacaggttgctatgttgatgaaatgatggctttgccgctgaagtactttgcggggggtctaccaagccaatacttacagggttaattgcaaacactcaagaatcacagtgtgtgaattgtgaaaggctcaattgcttttggtatggatcgagccttagataagtcattgaaaatgtgcactgttttgacagggacaatcaatataaccattacttttgtactgaaattttccattatttcccatggagtggtctgggtccggctgccatccatggtccaaagtattacacctgtgccattataattcagttgcatggcatgtgtcaagtgttattggcaggcagggactttcatcaccattcggagatgaaaaggacacatttgttcatcaggcctaccacatacataggtgttgcgctctagttcaggtttagatcatatagttcaaccagccaaatggcacctaaagttttacctacttcctaatagagcaactgctcaggttgaaaggaagcttagcttccctgggcttttgcatataacaaacatattatagggaaagcgagtgaaaatttatattacctgatttactattgtccattgcatttcaagaggaagctgagcaaagtcatcaaacttcgttcctattaagattgggattgccgtctgagttcaagagaggaaaaatgttaatataatcagcttaaacaatttatcagaacatattaatgtcataattgttttcatcgcactgatccaagcctacctaatctcttgggcaaggatactcataataattagaggaaaacgaaggtgagattttaataccttattccattttcttgcccgttgataccagtcgatggcgctgaatccaaaacaggacacaaatcataagtgatagaacaaaaaaaaaaaacttttaccgcatcatatctatggcatgtgtgtgtgtgtatataaaaggaacatccatgacatatgttacttggttcggattagtacacatttattgttgctgtacttagcaccataaaacaaggaatattatcagtgtgttgacataatctaaagccttcttttaatttctaacaaaagaatatttctggatctcgtaattttcagtagcatgacaaaaaagaaaaatcagaccgaaccaaaaatccaaatttagaaattagataataaacaaataaataaaaatacaaaagtattcgtacttatttagtgtgcaacggctggttagatcgaacataataagaatcgctgcagcatctttacaagctatagggagatgatcaagaaactgccgatcacctacaagtacacataaaaaaagataaaaatgagagaaggatctaaagaactaactaaataagacacaacaaaattaaaatatgcagataaaaaagaggggggagaaattacctccaacatcctacaagtacatataaaaaagctaaaaatgagaaaaagacttaaagaactaactaaataagaaacaataaaattaaaatgttcagagataaaagaggggggaggaattacctccaacatcccaaatactaaatgcaatcctcgcccccctaacgaccaaaatcttatccattaaatttagccctgtcatctgcagccccatctgttcctccacatcccccacatacttaacctaaacaaccaccaaaattaagagatcacaataaattagcattaattctattacaaaaaatttaaacccccccccaaaaaaactataactgtaattaagaatcaatatttttatatatataccatgaagcttgtttttccgatatggcagtcgccaaggaggctaatcttcagcggcaccaaatcggaatccacctcgatatcgccgcatgcttccgtggaccctgcggccgccgcggggatgtcctcgagctgcggcgagaagcatcccttgagccgccggtaccgggcgtggcggccgggtgaagaacatgctaggagatggtcccagaggaggcggaagaagcggcggacgacggcgagatggacgaagcgagcccacttatggtccagacgagtcagcgttcggctgaagtgagtcatgacgaggtggtggtggtggaggaggagggttgaaggccaggccccgccatcaacaaaggagggggggaggaggaggagtagctattttattattgttggaggtgctttgttttgtttcctctctttgtgtcctctcctcccctcctctcctctcttttaagttttaatctgcttctctatctactattgttgttgcgttaacgaccggatggtgcgaaagagactgcgtgtggagggggacggttgaccgattaggggagatacctttggtcggtccaatttgccggcttcttgtgcaagagagagggttatgcccatctttataggcatttggtcctttcggtcattcggctgtagctctggagggccgatttgcttcttaacttgaaatatagaaaagctaagtaattaactaggtaatcatgcaataacacattttggaatgaggaagctgggaagtactgttgagaattactgccaacttttcatgtgaagtgttagctgctaagcaaccatcaaatggcaatttgcagaaaaggggctattgatggttgccaatagaccacaaacatcgttcgttgcttagtgcgtgtcagtgagaaaatccacgtatgatgaaggtttcataatttcaatagagtaaaacacgttggtcatttgaaggtttaactaattgttgctgcttgttacagaggaataaccaaataatattcaattgtgttttcctttgttctagaattctaatgacgaggattcttctagaatcagttttctttttaatcaagaatgcctatccggttattagaaagctgatggtttttgtatgaaattgtcaagtatatatgggctatatgaaagaattcccactataaaatagagtacagtacttgctatttatctttccaaccataaatatgctctttgacagaaacgcatatatactttaattgttttttccgtcccagtgttttagttgcatctcttgatgattttgcataacttaccctaattacccgaaaaaaatggaatcacacttttcgaaaggacggctttcatttgctataaaacttgtgcacttgctacgaagtagcagtgtgtatttcaattcgccaacctatacgaaaccttggcattggtttaggatcttaaggtacgtcttttgagtcattcctcggtcaatcactaaaacaccttcctttgaataagtcagcaaggttgcaatcacttacatgcatggtacttactctacagtttcattttaaattttttctacaatcttattataatataagttgcactaaaatataaagcaatcaatatttctgctggaagcgtctaatgctcacttgcggcgaaccaaatgcaaggtccctggatatagcttatagatatactcaaggatgattaacagagaaaaaagtaaccaataatttttaagctttggtacaaaacctaattccacattaggtttgaccccaccaaaacctagcacggcctgcggaacatctaaaccactaaagtttcaaagaatatcagcttagaactgtgggcttttgtgcccatgatctcgttataatgggtgcttagcaaagattagtggtcctataattgtatggttggtgaggatcatagattaattagcagccaatttctaggttcagaagttgagtggctgggccatcaaaggacgagtggaggagaagggccccattttgtttcaaaggaggcttagaacttgtttatgtggtctccatcaggactcgagttgggcatttaaaaagttgatggctattagcatcgagtaaagccaaaggatagaacgcaagggccaagccatgggctgtcctcaaaaagtatttttttagagaatccattggttggaataggtccaccaccgagctggtggaccaatcgaaccagaaggcaacacggacaaagaagaaataggagggaaaaagaaggtgaggaatgtgttgctgcctgattggactaatccactagatctgctctaactaaaaatttcgcaccttcaccaaatctccaagtaattcaagatgaactaatgagatgtgggactagccgtcctagctggtgatttaaattgtacaccttaaagtagactaggttgttacacttcagcacatttaaaatttgaattaggcaccgcttagccctgtgtttaaataattaatataaagttgttattataagagatctattattaattaatggtagttttctttataggtctatttggacataccaacaaacatccgatgaagactaatattcctctaattgagtgccagtcagtcatgagcttcttttgaatttgtttttatgcatcagattccgttgctgctactgcctagaaaaattatcaataaatgtttacaaggataattgtttggaccgtcagttcgcgttcctaatttgactacatgcaaaatagtaggggaataaattggttagcttgctagaagataagaacttcagtcctttcatgatcttgattttgactagaagagaataatatctgaaccaagattgaattggaatctttgtctaggtcgattttaaagaaatcttatggcaatgtgtctatcatttttaagaaaatcgtagtatcactattgaaaatcgtgttgttctggcaggatgtgggtatcagatgggcaaaaggacagaggaaatagggtacgtgcatatcaggatcaagttaagtttcaatagacttaggcatattaggtgcaccatgattgatatttttatattaccttatcataaaatgattaagtttcttgatcgatattgttgagactatacagtcgacctccgactccgactctatattggccttatgaacataa

SEQ ID NO: 18 - DNA, 18 bp, Artificial Sequence
  synthetic genomic VIR gene PCR amplification forward primer
gcgtacgtggaaccacaa

SEQ ID NO: 19 - DNA, 22 bp, Artificial Sequence
  synthetic genomic VIR gene PCR amplification reverse primer
ctccattctggtgagaaagcgt

SEQ ID NO: 20 - DNA, 923 bp, Elaeis guineensis
  wild-type (nigrescens) VIR cDNA
  exon (269)...(923): exon 3
atgggtaatttgcgtgccgaagtccaacgtccagctggtgttcgcaaaggagcatggagtgaagaggaggacaggcttctgagaaagtgcgttgagaaatatggcgaagggaactggcgccatgttccccaaagggcaggcctcagaaggtgccgaaagagctgccgactacggtggttgaactatctcagccctaggatcaacagggagaaattttcggaggaagaaacagatcttatcatcaggcttcataagctcttgggcaacaggtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 21 - DNA, 654 bp, Elaeis guineensis
  VIR Event 1 exon 3 sequence
gtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaatgaatttggaatcggaggcttggaggaaaattgagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 22 - DNA, 654 bp, Elaeis guineensis
  VIR Event 2 exon 3 sequence
gtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaattaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 23 - DNA, 654 bp, Elaeis guineensis
  VIR Event 3 exon 3 sequence
gtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtagctgaattgtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 24 - DNA, 652 bp, Elaeis guineensis
  VIR Event 4 exon 3 sequence
gtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttatggtcagaagatcagcaatcatgtggaagccagcagccgcaagaaaagtttgggataccagaactaccgacaatctcagagaacgatgaagcgtggctgaattgtaatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagtatttagagcttcatatcctacaaaaagacaggaaacgagaccttgaaaaaagactcagtaccagaaggcatccacttattgattgcttttatacttgcaacatgaaggaagcacgctttctcaccaaaaaaaaaa

SEQ ID NO: 25 - DNA, 304 bp, Elaeis guineensis
  VIR Event 5 exon 3 sequence
gtggtcattaattgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttttggtcagaagatcagcaatcatgtggaagccagcagccgcaagaagattaatgctttgggccactatatagtgcttatatatgggatgacttgctttgggccactatatagtgcttatatatggtagtgcaatag

SEQ ID NO: 26 - protein, 86 aa, Elaeis guineensis
  DOMAIN (1)...(86): wild-type VIR carboxy-terminal region, activation domain
QQSCGSQQPQEKFGIPELPTISENDEAWLNCIMNGDRENSAVPDVGNGSTMNLQNEFGIGGLEENRDGAVFLEGVLGWDDLLWATI

SEQ ID NO: 27 - protein, 65 aa, Elaeis guineensis
  DOMAIN (1)...(65): Event 1 VIR mutant carboxy-terminal region, activation domain premature termination by nonsense point mutation
QQSCGSQQPQEKFGIPELPTISENDEAWLNCIMNGDRENSAVPDVGNGSTMNLQNEFGIGGLEEN

SEQ ID NO: 28 - protein, 55 aa, Elaeis guineensis
  DOMAIN (1)...(55): Event 2 VIR mutant carboxy-terminal region, activation domain premature termination by nonsense point mutation
QQSCGSQQPQEKFGIPELPTISENDEAWLNCIMNGDRENSAVPDVGNGSTMNLQN

SEQ ID NO: 29 - protein, 27 aa, Elaeis guineensis
  DOMAIN (1)...(27): Event 3 VIR mutant carboxy-terminal region, activation domain premature termination by nonsense point mutation
QQSCGSQQPQEKFGIPELPTISENDEA

SEQ ID NO: 30 - protein, 35 aa, Elaeis guineensis
  DOMAIN (1)...(35): Event 4 VIR mutant carboxy-terminal region, activation domain premature termination by frameshift deletion
QQSCGSQQPQEKFGIPELPTISENDEAWLNCNEWR

SEQ ID NO: 31 - protein, 12 aa, Elaeis guineensis
  DOMAIN (1)...(12): Event 5 VIR mutant carboxy-terminal region, activation domain premature termination by rearrangement
QQSCGSQQPQED

SEQ ID NO: 32 - protein, 112 aa, Zea mays
  DOMAIN (1)...(112): R2 and R3 domians of MYB protein (Zm_m_C1)
MGRRACCAKEGVKRGAWTSKEDDALAAYVKAHGEGKWREVPQKAGLRRCGKSCRLRWLNYLRPNIRRGNISYDEEDLIIRLHRLLGNRWSLIAGRLPGRTDNEIKNYWNSTL

SEQ ID NO: 33 - protein, 123 aa, Sorghum bicolor
  DOMAIN (1)...(123): R2 and R3 domians of MYB protein (Sb_m_C1)
MGRRACCAKEGVKRGAWTAKEDDVLAAYVKAHGEGKWREVPQKAGLRRCGKSCRLRWLNYLRPNIKRGNISYDEEDLIIRLHKLLGNRSVSVVRAGGGRWSLIAGRLPGRTDNEIKNYWNSTL

SEQ ID NO: 34 - protein, 112 aa, Oryza sativa
  DOMAIN (1)...(112): R2 and R3 domians of MYB protein (Os_m_C1)
MGRRACCAKEGMKRGAWTSKEDDVLASYIKSHGEGKWREVPQRAGLRRCGKSCRLRWLNYLRPNIKRGNIDDDEEELIVRLHTLLGNRWSLIAGRLPGRTDNEIKNYWNSTL

SEQ ID NO: 35 - protein, 112 aa, Epimedium sagittatum
  DOMAIN (1)...(112): R2 and R3 domians of MYB protein (Es_d_MYB10)
MGRSPCCSKEGLNRGAWTSTEDKLLKDYIRVHGEGKWRSLPPRAGLKRCGKSCRLRWLNYLRPDIKRGNITHDEEELIIRLHKLLGNRWSLIAGRLPGRTDNEIKNYWNTNL

SEQ ID NO: 36 - protein, 113 aa, Rosa rugosa
  DOMAIN (1)...(113): R2 and R3 domians of MYB protein (Rr_d_MYB)
MGRSSSRCDKEGANKGAWTAHEDQVLRDYVKEYGEGKWGKMSRETGLKRCGKSCRLRWLNYLRPDIKRGNITEDEEELIIRLHKLLGNRWSLIAGRLPGRTDNEIKNYWNSTI

SEQ ID NO: 37 - protein, 103 aa, Rubus sp.
  DOMAIN (1)...(103): R2 and R3 domians of MYB protein (Rubus hybrid, Rubus_d_R2R3)
MEVRKGAWTKEEDHLLRNYIEKNGEGKWHNVPLNAGLNRCRKSCRMRWLNYLKPNIKKGDFSENEVDLMIRLRKLLGNRWSLIAGRLPGRTSNDVKNYWSARR

SEQ ID NO: 38 - protein, 103 aa, Rubus idaeus
  DOMAIN (1)...(103): R2 and R3 domians of MYB protein (Ri_d_R2R3)
MEVRKGAWTKEEDHLLRNYIEKHGEGRWHKVPLQAGLNRCRKSCRMRWLNYLKPNIKRGDFAEDEVDLMIRLRKLLGNRWSLIAGRLPGRTSNDVKNYWSARQ

SEQ ID NO: 39 - protein, 108 aa, Prunus persica
  DOMAIN (1)...(108): R2 and R3 domians of MYB protein (Pp_d_R2R3)
MEGYDLSVRKGAWTREEDDLLRQCIENQGEGKWHQVPYKAGLNRCRKSCRLRWVNYLKPNIKKGEFAEDEVDLIIRLHKLLGNRWSLIARRLPGRTANNVKNYWNTRS

SEQ ID NO: 40 - protein, 108 aa, Prunus dulcis
  DOMAIN (1)...(108): R2 and R3 domians of MYB protein (Pd_d_R2R3)
MEGYNLGVRKGAWTREEDDLLRQCIENQGEGKWHQVPYKAGLKRCRKSCRLRWVNYLKPNIKRGEFAEDEVDLIIRLHKLLGNRWSLIAGRLPGRTANDVKNYWNTRL

SEQ ID NO: 41 - protein, 108 aa, Prunus persica
  DOMAIN (1)...(108): R2 and R3 domians of MYB protein (Pp_d_MYB10)
MEGYNLGVRKGAWTREEDDLLRQCIENHGEGKWHQVPNKAGLNRCRKSCRLRWMNYLKPNIKRGEFAEDEVDLIIRLHKLLGNRWSLIAGRLPGRTANDVKNYWNTRL

SEQ ID NO: 42 - protein, 110 aa, Malus x domestica
  DOMAIN (1)...(110): R2 and R3 domians of MYB protein (Md_d_MYB10 and Malus hybrid, Malus_d_MYB10)
MEGYNENLSVRKGAWTREEDNLLRQCVEIHGEGKWNQVSYKAGLNRCRKSCRQRWLNYLKPNIKRGDFKEDEVDLIIRLHRLLGNRWSLIARRLPGRTANAVKNYWNTRL

SEQ ID NO: 43 - protein, 110 aa, Malus pumila
  DOMAIN (1)...(110): R2 and R3 domians of MYB protein (Mp_d_MYB10)
MEGYNENLSVRKGAWTREEDDLLRQCIEIHGEGKWRQLPNKAGLNTCRKSCRLRWLNYLKPNIKRGDFKEDEVDLIIRLHRLLGNRWSLIARRLPGRTANAVKNYWNTRL

SEQ ID NO: 44 - protein, 106 aa, Fragaria x ananassa
  DOMAIN (1)...(106): R2 and R3 domians of MYB protein (Frag_d_R2R3)
MEGFGVRKGAWTKEEDELLKQFIEIHGEGKWHHVPLKSGLNRCRKSCRLRWLNYLKPNIKRGEFAEDEVDLIIRLHKLLGNRWSLIAGRLPGRTANDVKNYWNTYQ

SEQ ID NO: 45 - protein, 107 aa, Fragaria vesca
  DOMAIN (1)...(107): R2 and R3 domians of MYB protein (Fv_d_R2R3)
MEGYFGVRKGAWTKEEDELLKQFIEIHGEGKWHHVPLKSGLNRCRKSCRLRWLNYLKPNIKRGEFAEDEVDLIIRLHKLLGNRWSLIAGRLPGRTANDVKNYWNTYQ

SEQ ID NO: 46 - protein, 109 aa, Gerbera hybrida
  DOMAIN (1)...(109): R2 and R3 domians of MYB protein (Ger_d_MYB10)
MGAEARSGLRKGAWTAEEDMLLKNCIERYGEGKWHLVPLKAGLNRCRKSCRLRWLNYLRPNIKRGDFGEDEIDLIIRLHKLLGNRWSLIAGRIPGRTANDVKNWWNTHL

SEQ ID NO: 47 - protein, 121 aa, Medicago truncatula
  DOMAIN (1)...(121): R2 and R3 domians of MYB protein (Mt_d_MYB113)
MPLFVCGQKQVYMEKCKTRGVRKGAWTYEEDKLLKACMQKYGEGKWHLVPQRAGLNRCRKSCRLRWLNYLNPTINRESFSEDEVDMILRLHKLLGNRWSLIAARLPGRTANDVKNYWHTHL

SEQ ID NO: 48 - protein, 107 aa, Glycine max
  DOMAIN (1)...(107): R2 and R3 domians of MYB protein (Gm_d_MYB10)
MERSSGIRKGTWTVEEDKLLRMCVEKYGEGKWHQIPKKAGLNRCRKSCRLRWLNYLKPNIKRGDFLADEVDLMLKLHKLLGNRWSLIAGRLPGRTANDVKNFWNTHL

SEQ ID NO: 49 - protein, 107 aa, Vitis vinifera
  DOMAIN (1)...(107): R2 and R3 domians of MYB protein (Vv_d_MYB113a)
MEGSLGLRKGAWTSEEDHLLRKCVEKYGEGKWHQVPFRAGLNRCRKSCRLRWLNYLKPDIKRGKFTADEVDLMMRLHKLLGNRWALIAGRLPGRTSNDVKNYWNTHL

SEQ ID NO: 50 - protein, 108 aa, Arabidopsis thaliana
  DOMAIN (1)...(108): R2 and R3 domians of MYB protein (At_d_PAP1)
MEGSSKGLRKGAWTTEEDSLLRQCINKYGEGKWHQVPVRAGLNRCRKSCRLRWLNYLKPSIKRGKLSSDEVDLLLRLHRLLGNRWSLIAGRLPGRTANDVKNYWNTHL

SEQ ID NO: 51 - protein, 108 aa, Arabidopsis thaliana
  DOMAIN (1)...(108): R2 and R3 domians of MYB protein (At_d_MYB90)
MEGSSKGLRKGAWTAEEDSLLRLCIDKYGEGKWHQVPLRAGLNRCRKSCRLRWLNYLKPSIKRGRLSNDEVDLLLRLHKLLGNRWSLIAGRLPGRTANDVKNYWNTHL

SEQ ID NO: 52 - protein, 108 aa, Brassica rapa
  DOMAIN (1)...(108): R2 and R3 domians of MYB protein (Br_d_PAP1)
MEDSSKGLKKGAWTAEEDNLLRQCIDKYGEGKWHQVPLRAGLNRCRKSCRLRWLNYLKPSIKRGKLNSDEVDLLMCLHKLLGNRWSLIAGRLPGRTANDVKNYWNTHL

SEQ ID NO: 53 - protein, 108 aa, Arabidopsis thaliana
  DOMAIN (1)...(108): R2 and R3 domians of MYB protein (At_d_MYB113)
MGESPKGLRKGTWTTEEDILLRQCIDKYGEGKWHRVPLRTGLNRCRKSCRLRWLNYLKPSIKRGKLCSDEVDLVLRLHKLLGNRWSLIAGRLPGRTANDVKNYWNTHL

SEQ ID NO: 54 - protein, 106 aa, Vitis vinifera
  DOMAIN (1)...(106): R2 and R3 domians of MYB protein (Vv_d_MYB113)
MESLGVTKGKWTREEDILLRKCVENYGEEKWHLVPLRAGLSRCRKSCRLRWFNYLKPNIKRGKFASDEVDLMIRLHKLLGNRWSLIAGRLPGRTANDVKNYWHHHR

SEQ ID NO: 55 - protein, 107 aa, Glycine max
  DOMAIN (1)...(107): R2 and R3 domians of MYB protein (Gm_d_MYB113)
MDGSACVRKGLWSEVEDTLLRTCVRQYGEGQWHLVPTRAGLNRCRKSCRLRWLNYLKPNIKRGEFTEDEVDLMQRLHNLLGNRWSLIAGRLPGRTPNDVKNYWNTYI

SEQ ID NO: 56 - protein, 114 aa, Elaeis guineensis
  DOMAIN (1)...(114): R2 and R3 domians of MYB protein (Eg_m_vir and Eg_m_nig)
MGNLRAEVQRPAGVRKGAWSEEEDRLLRKCVEKYGEGNWRHVPQRAGLRRCRKSCRLRWLNYLSPRINREKFSEEETDLIIRLHKLLGNRWSLIAGRLPGRTANDIKNYWNTHL

SEQ ID NO: 57 - protein, 112 aa, Picea glauca
  DOMAIN (1)...(112): R2 and R3 domians of MYB protein (Pg_d_Myb10)
MGRSPCCEKSHTNKGAWTKEEDDRLIAHIRAHGEGGWRSLPKAAGLLRCGKSCRLRWINYLRPDLKRGNFSEEEDELIIKLHSILGNKWSLIAARLPGRTDNEIKNYWNSHI

SEQ ID NO: 58 - protein, 112 aa, Gossypium hirsutum
  DOMAIN (1)...(112): R2 and R3 domians of MYB protein (Gh_d_MYB10)
MGRSPCCEKAHTNKGTWTKEEDQRLIDYIRLRGEGCWRSLPKAAGLLRCGKSCRLRWINYLRPDLKRGNFSEAEDELIIKLHSLLGNKWSLIAARLPGRTDNEIKNYWNTHI

SEQ ID NO: 59 - protein, 112 aa, Dendrobium sp.
  DOMAIN (1)...(112): R2 and R3 domians of MYB protein (Dendrobium sp. XMW-2002-10, Dend_m_myb10)
MGRSACCEKAHTNKGAWTKEEDERLIAHIRTHGEGCWRSLPKAAGLLRCGKSCRLRWINYLRPDLKRGNFTDEEDELIIKLHSLLGNKWSLIAGRLPGRTDNEIKNYWNTHI

SEQ ID NO: 60 - protein, 112 aa, Oryza sativa
  DOMAIN (1)...(112): R2 and R3 domians of MYB protein (Os_m_MYB10)
MGRSPCCEKAHTNKGAWTKEEDQRLIAHINQHGEGCWRSLPKAAGLLRCGKSCRLRWINYLRPDLKRGNFTDEEDELIIKLHELLGNKWSLIAGRLPGRTDNEIKNYWNTHI

SEQ ID NO: 61 - protein, 114 aa, Arabidopsis thaliana
  DOMAIN (1)...(114): R2 and R3 domians of MYB protein (At_d_MYB10 and At_d_MYB10b)
MGNRRAPCCDKSQVKRGPWSDEESERLRSFILKNGHQNWRSLPKLAGLMRCGKSCRLRWINYLRPGLKRGNFTKEEEDTIIHLHQAYGNKWSKIASNFPGRTDNEIKNVWNTHL

SEQ ID NO: 62 - DNA, 923 bp, Elaeis guineensis; identical to SEQ ID NO: 20
  wild-type VIR allele, wild type allele RTPAP1_mrna

SEQ ID NO: 63 - DNA, 923 bp, Elaeis guineensis; identical to SEQ ID NO: 7
  mutant VIR allele, mutant allele SNP_1

SEQ ID NO: 64 - DNA, 923 bp, Elaeis guineensis; identical to SEQ ID NO: 9
  mutant VIR allele, mutant allele SNP_2

SEQ ID NO: 65 - DNA, 923 bp, Elaeis guineensis; identical to SEQ ID NO: 11
  mutant VIR allele, mutant allele SNP_3

SEQ ID NO: 66 - DNA, 921 bp, Elaeis guineensis; identical to SEQ ID NO: 13
  mutant VIR allele, mutant allele SNP_4

SEQ ID NO: 67 - DNA, 761 bp, Elaeis guineensis; identical to SEQ ID NO: 15
  mutant VIR allele, mutant allele SNP_5

SEQ ID NO: 68 - DNA, 369 bp, Artificial Sequence
  synthetic Event2-vir allele
gtaccgttgcaatggttatggtcagaagatcagcaatcatgtggaagccagcagccgcaagaaaagtttgggataccagaactaccgacaatctcagagaacgatgaagcgtggctgaattgtataatgaatggagatagagagaacagtgcagtgccagacgttggaaacgggagcacaatgaacctgcagaattaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaattcccatgcaagta

SEQ ID NO: 69 - DNA, 21 bp, Artificial Sequence
  synthetic Event2-vir allele forward amplification primer
tgcaatggttatggtcagaag

SEQ ID NO: 70 - DNA, 19 bp, Artificial Sequence
  synthetic Event2-vir allele reverse amplification primer
gtaatttcaagctttgttg

SEQ ID NO: 71 - DNA, 74 bp, Artificial Sequence
  synthetic wild-type VIR allele template
aggaggttcggaggctaaggtttaagtaagacgtccaagtaacacgagggcaaaggttgcagaccgtgacgtga

SEQ ID NO: 72 - DNA, 22 bp, Artificial Sequence
  synthetic wild-type VIR allele and Event2-vir allele exemplary primer
gagcacaatgaacctgcagaat

SEQ ID NO: 73 - DNA, 23 bp, Artificial Sequence
  synthetic wild-type VIR allele primer extension product
  modified_base (23)...(23): c modified by fluorescein derivative FAM
gagcacaatgaacctgcagaatc

SEQ ID NO: 74 - DNA, 74 bp, Artificial Sequence
  synthetic Event2-vir allele template
aggaggttcggaggctaaggtttaattaagacgtccaagtaacacgagggcaaaggttgcagaccgtgacgtga

SEQ ID NO: 75 - DNA, 23 bp, Artificial Sequence
  synthetic Event2-vir allele primer extension product
  modified_base (23)...(23): a modified by rhodamine derivative TAM, TAMRA
gagcacaatgaacctgcagaata

SEQ ID NO: 76 - DNA, 384 bp, Artificial Sequence
  synthetic Event3-vir allele
aaagtaattaagccacggccatggaaagtaccgttgcaatggttatggtcagaagatcagcaatcatgtggaagccagcagccgcaagaaaagtttgggataccagaactaccgacaatctcagagaacgatgaagcgtagctgaattgtataatgaatggagatagagagaacagtgcagtgccagacgttggaaacgggagcacaatgaacctgcagaatgaatttggaatcggaggcttggaggaaaatagagatggggcagtgtttctggaaggagttctaggatgggatgacttgctttgggccactatatagtgctcatatatggtagtgcaatagttgccattataagttgtttcgaactttaatgctcctgaaatt

SEQ ID NO: 77 - DNA, 21 bp, Artificial Sequence
  synthetic Event3-vir allele forward amplification primer
tgcaatggttatggtcagaag

SEQ ID NO: 78 - DNA, 18 bp, Artificial Sequence
  synthetic Event3-vir allele reverse amplification primer
taatttcaagctttgttg

SEQ ID NO: 79 - DNA, 70 bp, Artificial Sequence
  synthetic wild-type VIR allele template
aactaccgacaatctcagagaacgatgaagcgtggctgaattgtataatgaatggagatagagagaacag

SEQ ID NO: 80 - DNA, 18 bp, Artificial Sequence
  synthetic wild-type VIR allele and Event3-vir allele exemplary primer
aagtaatatgttaagtcg

SEQ ID NO: 81 - DNA, 19 bp, Artificial Sequence
  synthetic wild-type VIR allele primer extension product
  modified_base (19)...(19): c modified by fluorescein derivative FAM
aagtaatatgttaagtcgc

SEQ ID NO: 82 - DNA, 70 bp, Artificial Sequence
  synthetic Event3-vir allele template
aactaccgacaatctcagagaacgatgaagcgtagctgaattgtataatgaatggagatagagagaacag

SEQ ID NO: 83 - DNA, 19 bp, Artificial Sequence
  synthetic Event2-vir allele primer extension product
  modified_base (19)...(19): t modified by rhodamine derivative TAM, TAMRA
aagtaatatgttaagtcgt

SEQ ID NO: 84 - DNA, 292 bp, Artificial Sequence
  synthetic Event5-vir allele
tgcaggtaggcttccaggcaggacagcaaatgacatcaagaactactggaacactcacctgggcaagaaagtagaagttgaaaacaagaaggcggagcccagtgctgatgccaaagtaattaagccacggccatggaaagtaccgttgcaatggttttggtcagaagatcagcaatcatgtggaagccagcagccgcaagaagattaatgctttgggccactatatagtgcttatatatgggatgacttgctttgggccactatatagtgcttatatatggtagtgcaatag

SEQ ID NO: 85 - DNA, 21 bp, Artificial Sequence
  synthetic Event5-vir allele forward amplification primer
tgcaatggttttggtcagaag

SEQ ID NO: 86 - DNA, 23 bp, Artificial Sequence
  synthetic Event5-vir allele reverse amplification primer
atggtatatattcgtgatatatc

SEQ ID NO: 87 - DNA, 80 bp, Artificial Sequence
  synthetic wild-type VIR allele template
agatcagcaatcatgtggaagccagcagccgcaagaaaagtttgggataccagaactaccgacaatctcagagaacgatg

SEQ ID NO: 88 - DNA, 80 bp, Artificial Sequence
  synthetic wild-type VIR allele template complement
catcgttctctgagattgtcggtagttctggtatcccaaacttttcttgcggctgctggcttccacatgattgctgatct

SEQ ID NO: 89 - DNA, 18 bp, Artificial Sequence
  synthetic wild-type VIR allele and Event5-vir allele exemplary primer
tcggtcgtcggcgttctt

SEQ ID NO: 90 - DNA, 19 bp, Artificial Sequence
  synthetic wild-type VIR allele primer extension product
  modified_base (19)...(19): a modified by fluorescein derivative FAM
tcggtcgtcggcgttctta

SEQ ID NO: 91 - DNA, 80 bp, Artificial Sequence
  synthetic Event5-vir allele template
agatcagcaatcatgtggaagccagcagccgcaagaagattaatgctttgggccactatatagtgcttatatatgggatg

SEQ ID NO: 92 - DNA, 80 bp, Artificial Sequence
  synthetic Event5-vir allele template complement
catcccatatataagcactatatagtggcccaaagcattaatcttcttgcggctgctggcttccacatgattgctgatct

SEQ ID NO: 93 - DNA, 19 bp, Artificial Sequence
  synthetic Event5-vir allele primer extension product
  modified_base (19)...(19): g modified by rhodamine derivative TAM, TAMRA
tcggtcgtcggcgttcttg

SEQ ID NO: 94 - DNA, 82 bp, Artificial Sequence
  synthetic Event1-vir allele template
aatgaacctgcagaatttggaatcggaggcttggaggaaaatagagatggggcagtgtttctggaaggagttctaggatggg

SEQ ID NO: 95 - DNA, 18 bp, Artificial Sequence
  synthetic wild-type VIR allele and Event1-vir allele exemplary primer
ctttgtgacggggtagag

SEQ ID NO: 96 - DNA, 19 bp, Artificial Sequence
  synthetic wild-type VIR allele primer extension product
  modified_base (19)...(19): t modified by fluorescein derivative FAM
ctttgtgacggggtagagt

SEQ ID NO: 97 - DNA, 86 bp, Artificial Sequence
  synthetic Event1-vir allele template
aatgaacctgcagaatgaatttggaatcggaggcttggaggaaaattgagatggggcagtgtttctggaaggagttctaggatggg

SEQ ID NO: 98 - DNA, 19 bp, Artificial Sequence
  synthetic Event1-vir allele primer extension product
  modified_base (19)...(19): a modified by rhodamine derivative TAM, TAMRA
ctttgtgacggggtagaga

SEQ ID NO: 99 - DNA, 82 bp, Artificial Sequence
  synthetic Event4-vir allele template
ccagaactaccgacaatctcagagaacgatgaagcgtggctgaattgttaaatgaatggagatagagagaacagtgcagtgc

SEQ ID NO: 100 - DNA, 82 bp, Artificial Sequence
  synthetic Event4-vir allele template complement
gcactgcactgttctctctatctccattcatttaacaattcagccacgcttcatcgttctctgagattgtcggtagttctgg

SEQ ID NO: 101 - DNA, 18 bp, Artificial Sequence
  synthetic wild-type VIR allele and Event4-vir allele exemplary primer
cttcgcaccgacttaaca

SEQ ID NO: 102 - DNA, 19 bp, Artificial Sequence
  synthetic wild-type VIR allele primer extension product
  modified_base (19)...(19): t modified by fluorescein derivative FAM
cttcgcaccgacttaacat

SEQ ID NO: 103 - DNA, 80 bp, Artificial Sequence
  synthetic Event4-vir allele template
ccagaactaccgacaatctcagagaacgatgaagcgtggctgaattgtaatgaatggagatagagagaacagtgcagtgc

SEQ ID NO: 104 - DNA, 80 bp, Artificial Sequence
  synthetic Event4-vir allele template complement
gcactgcactgttctctctatctccattcattacaattcagccacgcttcatcgttctctgagattgtcggtagttctgg

SEQ ID NO: 105 - DNA, 19 bp, Artificial Sequence
  synthetic Event4-vir allele primer extension product
  modified_base (19)...(19): a modified by rhodamine derivative TAM, TAMRA
cttcgcaccgacttaacaa

What is claimed is:

1. A method for determining a fruit color phenotype of an *E. guineensis* palm plant, the method comprising,
providing a sample from an *E. guineensis* palm plant or seed;
detecting in the sample presence or absence of a VIR gene alteration in a genomic region corresponding to SEQ ID NO:1 that comprises a VIR gene and confers a *virescens* phenotype to fruit, wherein the detecting comprises detecting the VIR gene alteration by amplification, hybridization, or nucleotide sequencing, wherein the gene alteration in causes the *virescens* phenotype, wherein the VIR gene alteration comprises a nucleotide change that results in a premature stop codon; and
segregating the *E. guineensis* palm plant or seed into groups based on the presence of the VIR gene alternation, wherein at least one group contains *E. guineensis* palm plants or seeds having the VIR gene alteration in the genomic region corresponding to SEQ ID NO: 1.

2. The method of claim 1, wherein the VIR gene alteration generates a truncated protein compared to the protein encoded by SEQ ID NO:4.

3. The method of claim 1 wherein the VIR gene alteration results in the sequence of any one of SEQ ID NOS:7, 9, 11, 13, and 15, or the VIR gene alteration results in a sequence that encodes an amino acid sequence selected from the group consisting of SEQ ID NOS:5, 8, 10, 12, and 14.

4. The method of claim 1, wherein the VIR gene encodes (i) a polypeptide at least 95% identical to SEQ ID NO:4.

5. The method of claim 1, wherein the plant is less than 5 years old.

6. The method of claim 1, wherein the plant is less than one year old.

7. The method of claim 1, further comprising selecting the *E. guineensis* palm plant or seed for cultivation if the *E. guineensis* palm plant or seed has the VIR gene alteration.

8. The method of claim 7, wherein the *E. guineensis* palm plant or seed is discarded if the *E. guineensis* palm plant or seed does not have the VIR gene alteration.

9. The method of claim 1, wherein the segregating comprises segregating the *E. guineensis* palm plant or seed into a first group based on the presence of the VIR gene alteration and segregating the *E. guineensis* palm plant or seed into a second group based on the absence of the VIR gene alteration.

10. The method of claim 9, wherein the absence of the VIR gene alteration results in a *nigrescens* phenotype.

11. The method of claim 1, wherein the method further comprises amplifying genomic DNA from the sample prior to the detecting.

12. A method for determining a fruit color phenotype of an *E. guineensis* palm plant, the method comprising,
providing a sample from an *E. guineensis* palm plant or seed;
detecting in the sample presence or absence of a VIR gene alteration in a genomic region corresponding to SEQ ID NO:1 that comprises a VIR gene and confers a *virescens* phenotype to fruit, wherein the gene alteration causes the *virescens* phenotype, wherein the VIR gene alteration results the sequence of any one of SEQ ID NOS:7, 9, 11, 13, and 15, wherein the detecting comprises detecting the VIR gene alteration by amplification, hybridization or nucleotide sequencing, wherein the VIR gene alteration comprises a nucleotide change that results in a premature stop codon; and
segregating the *E. guineensis* palm plant or seed into groups based on the presence of the VIR gene alternation, wherein at least one group contains *E. guineensis* palm plants or seeds having the VIR gene alteration in the genomic region corresponding to SEQ ID NO: 1.

13. The method of claim 1, wherein the detecting comprises obtaining the sequence of the VIR gene in the genomic region corresponding to SEQ ID NO:1.

14. The method of claim 1, wherein the detecting comprises obtaining the sequence of the VIR gene in the genomic region corresponding to SEQ ID NO:1.

* * * * *